US012790395B2

(12) United States Patent
Loew et al.

(10) Patent No.: US 12,790,395 B2
(45) Date of Patent: Nov. 10, 2026

(54) MULTIFUNCTIONAL MOLECULES THAT BIND TO T CELL RELATED CANCER CELLS AND USES THEREOF

(71) Applicant: Marengo Therapeutics, Inc., Cambridge, MA (US)

(72) Inventors: Andreas Loew, Boston, MA (US); Nidhi Malhotra, Boston, MA (US); Madan Katragadda, Acton, MA (US); Peter Marek, Boston, MA (US); Gurkan Guntas, Newton, MA (US); Sangeetha Palakurthi, East Walpole, MA (US)

(73) Assignee: Marengo Therapeutics, Inc., Cambridge, MA (US)

( * ) Notice: Subject to any disclaimer, the term of this patent is extended or adjusted under 35 U.S.C. 154(b) by 965 days.

(21) Appl. No.: 18/048,614

(22) Filed: Oct. 21, 2022

(65) Prior Publication Data

US 2023/0357395 A1 Nov. 9, 2023

Related U.S. Application Data

(63) Continuation of application No. PCT/US2021/028970, filed on Apr. 23, 2021.

(60) Provisional application No. 63/070,777, filed on Aug. 26, 2020, provisional application No. 63/014,920, filed on Apr. 24, 2020.

(51) Int. Cl.

| | |
|---|---|
| ***C07K 16/28*** | (2006.01) |
| ***A61K 39/00*** | (2006.01) |
| ***A61P 35/00*** | (2006.01) |
| ***C12N 15/85*** | (2006.01) |

(52) U.S. Cl.

CPC .......... *C07K 16/2809* (2013.01); *A61P 35/00* (2018.01); *C07K 16/2803* (2013.01); *C12N 15/85* (2013.01); *A61K 2039/505* (2013.01); *C07K 2317/24* (2013.01); *C07K 2317/31* (2013.01); *C07K 2317/565* (2013.01); *C07K 2317/622* (2013.01)

(58) Field of Classification Search

None

See application file for complete search history.

(56) References Cited

U.S. PATENT DOCUMENTS

| | | | |
|---|---|---|---|
| 861,745 | A | 7/1907 | Maxwell |
| 4,433,059 | A | 2/1984 | Chang et al. |
| 4,439,196 | A | 3/1984 | Higuchi |
| 4,444,878 | A | 4/1984 | Paulus |
| 4,447,224 | A | 5/1984 | DeCant, Jr. et al. |
| 4,447,233 | A | 5/1984 | Mayfield |
| 4,475,196 | A | 10/1984 | La Zor |
| 4,486,194 | A | 12/1984 | Ferrara |
| 4,487,603 | A | 12/1984 | Harris |
| 4,522,811 | A | 6/1985 | Eppstein et al. |
| 4,596,556 | A | 6/1986 | Morrow et al. |
| 4,676,980 | A | 6/1987 | Segal et al. |
| 4,737,456 | A | 4/1988 | Weng et al. |
| 4,790,824 | A | 12/1988 | Morrow et al. |
| 4,816,567 | A | 3/1989 | Cabilly et al. |
| 4,941,880 | A | 7/1990 | Burns |
| 5,057,423 | A | 10/1991 | Hiserodt et al. |
| 5,064,413 | A | 11/1991 | McKinnon et al. |
| 5,116,615 | A | 5/1992 | Gokcen et al. |
| 5,208,020 | A | 5/1993 | Chari et al. |
| 5,223,409 | A | 6/1993 | Ladner et al. |
| 5,225,539 | A | 7/1993 | Winter |
| 5,273,743 | A | 12/1993 | Ahlem et al. |
| 5,312,335 | A | 5/1994 | McKinnon et al. |
| 5,374,548 | A | 12/1994 | Caras |
| 5,383,851 | A | 1/1995 | McKinnon, Jr. et al. |
| 5,391,377 | A | 2/1995 | Barnwell |
| 5,399,163 | A | 3/1995 | Peterson et al. |
| 5,399,331 | A | 3/1995 | Loughrey et al. |
| 5,416,016 | A | 5/1995 | Low et al. |
| 5,416,064 | A | 5/1995 | Chari et al. |
| 5,500,362 | A | 3/1996 | Robinson et al. |

(Continued)

FOREIGN PATENT DOCUMENTS

| | | |
|---|---|---|
| AU | 5245399 A | 2/2000 |
| AU | 2001278662 B2 | 9/2006 |

(Continued)

OTHER PUBLICATIONS

Lamminmaki et al. “Crystal structure of a recombinant anti-estradiol Fab fragment in complex with 17beta -estradiol”, JBC 2001, 276:36687-36694 (Year: 2001).*

Rudikoff et al. “Single amino acid altering antigen-binding specificity”, Proc Natl Acad Sci USA 1982 vol. 79 p. 1979 (Year: 1982).*

MacCallum et al. “Antibody-antigen Interactions: Contact Analysis and Binding Site Topography”, J. Mol. Biol. (1996) 262, 732-745 (Year: 1996).*

Pascalis et al. “Grafting of “Abbreviated” Complementarity-Determining Regions Containing Specificity-Determining Residues Essential for Ligand Contact to Engineer a Less Immunogenic Humanized Monoclonal Antibody”, The Journal of Immunology (2002) 169, 3076-3084 (Year: 2002).*

(Continued)

*Primary Examiner* — Peter Johansen

(74) *Attorney, Agent, or Firm* — Wilson Sonsini Goodrich & Rosati

(57) ABSTRACT

Multifunctional molecules that include i) an antigen binding domain that binds to a T cell receptor beta chain constant domain 1 or T cell receptor beta chain constant domain 2; and one, two or all of: (ii) an immune cell engager (e.g., chosen from an NK cell engager, a T cell engager, a B cell engager, a dendritic cell engager, or a macrophage cell engager); (iii) a cytokine molecule or cytokine inhibitor molecule; (iv) a death receptor signal enhancer; and/or (v) a stromal modifying moiety are disclosed. Additionally disclosed are nucleic acids encoding the same, methods of producing the aforesaid molecules, and methods of treating a cancer using the aforesaid molecules.

19 Claims, 67 Drawing Sheets

Specification includes a Sequence Listing.

(56) References Cited

U.S. PATENT DOCUMENTS 5,534,254 A 7/1996 Huston et al.
5,571,894 A 11/1996 Wels et al.
5,582,996 A 12/1996 Curtis
5,585,089 A 12/1996 Queen et al.
5,587,458 A 12/1996 King et al.
5,591,828 A 1/1997 Bosslet et al.
5,624,821 A 4/1997 Winter et al.
5,626,561 A 5/1997 Butler et al.
5,635,483 A 6/1997 Pettit et al.
5,635,602 A 6/1997 Cantor et al.
5,637,481 A 6/1997 Ledbetter et al.
5,641,870 A 6/1997 Rinderknecht et al.
5,648,237 A 7/1997 Carter
5,648,260 A 7/1997 Winter et al.
5,693,761 A 12/1997 Queen et al.
5,693,762 A 12/1997 Queen et al.
5,712,374 A 1/1998 Kuntsmann et al.
5,714,586 A 2/1998 Kunstmann et al.
5,731,116 A 3/1998 Matsuo et al.
5,731,168 A 3/1998 Carter et al.
5,739,116 A 4/1998 Hamann et al.
5,747,036 A 5/1998 Brenner et al.
5,750,373 A 5/1998 Garrard et al.
5,766,947 A 6/1998 Rittershaus et al.
5,767,285 A 6/1998 Hamann et al.
5,770,429 A 6/1998 Lonberg et al.
5,770,701 A 6/1998 Mcgahren et al.
5,770,710 A 6/1998 Mcgahren et al.
5,773,001 A 6/1998 Hamann et al.
5,776,459 A 7/1998 Vandenbark
5,780,588 A 7/1998 Pettit et al.
5,787,900 A 8/1998 Butler et al.
5,789,199 A 8/1998 Joly et al.
5,811,097 A 9/1998 Allison et al.
5,821,337 A 10/1998 Carter et al.
5,831,012 A 11/1998 Nilsson et al.
5,837,242 A 11/1998 Holliger et al.
5,837,821 A 11/1998 Wu
5,840,523 A 11/1998 Simmons et al.
5,843,069 A 12/1998 Butler et al.
5,844,094 A 12/1998 Hudson et al.
5,849,500 A 12/1998 Breitling et al.
5,849,589 A 12/1998 Tedder et al.
5,861,155 A 1/1999 Lin
5,864,019 A 1/1999 King et al.
5,869,046 A 2/1999 Presta et al.
5,869,620 A 2/1999 Whitlow et al.
5,877,296 A 3/1999 Hamann et al.
5,902,745 A 5/1999 Butler et al.
5,910,573 A 6/1999 Plueckthun et al.
5,913,998 A 6/1999 Butler et al.
5,932,448 A 8/1999 Tso et al.
5,959,083 A 9/1999 Bosslet et al.
5,959,177 A 9/1999 Hein et al.
5,968,753 A 10/1999 Tseng-Law et al.
5,980,889 A 11/1999 Butler et al.
5,989,830 A 11/1999 Davis et al.
6,005,079 A 12/1999 Casterman et al.
6,040,498 A 3/2000 Stomp et al.
6,075,181 A 6/2000 Kucherlapati et al.
6,120,766 A 9/2000 Hale et al.
6,150,584 A 11/2000 Kucherlapati et al.
6,171,586 B1 1/2001 Lam et al.
6,171,799 B1 1/2001 Skibbens et al.
6,172,197 B1 1/2001 McCafferty et al.
6,194,551 B1 2/2001 Idusogie et al.
6,239,259 B1 5/2001 Davis et al.
6,248,516 B1 6/2001 Winter et al.
6,267,958 B1 7/2001 Andya et al.
6,291,158 B1 9/2001 Winter et al.
6,294,353 B1 9/2001 Pack et al.
6,333,396 B1 12/2001 Filpula et al.
6,352,694 B1 3/2002 June et al.
6,417,429 B1 7/2002 Hein et al.
6,420,548 B1 7/2002 Vezina et al.
6,476,198 B1 11/2002 Kang
6,511,663 B1 1/2003 King et al.
6,534,055 B1 3/2003 June et al.
6,582,915 B1 6/2003 Griffiths et al.
6,593,081 B1 7/2003 Griffiths et al.
6,602,684 B1 8/2003 Umana et al.
6,630,579 B2 10/2003 Chari et al.
6,632,427 B1 10/2003 Finiels et al.
6,670,453 B2 12/2003 Frenken et al.
6,696,245 B2 2/2004 Winter et al.
6,703,199 B1 3/2004 Koide
6,737,056 B1 5/2004 Presta
6,743,896 B2 6/2004 Filpula et al.
6,756,523 B1 6/2004 Kahn et al.
6,765,087 B1 7/2004 Casterman et al.
6,809,185 B1 10/2004 Schoonjans et al.
6,818,418 B1 11/2004 Lipovsek et al.
6,833,441 B2 12/2004 Wang et al.
6,838,254 B1 1/2005 Hamers et al.
6,905,680 B2 6/2005 June et al.
6,979,546 B2 12/2005 Moretta et al.
6,982,321 B2 1/2006 Winter
7,041,870 B2 5/2006 Tomizuka et al.
7,083,785 B2 8/2006 Browning et al.
7,087,409 B2 8/2006 Barbas, III et al.
7,105,149 B1 9/2006 Dalla-Favera
7,125,978 B1 10/2006 Vezina et al.
7,129,330 B1 10/2006 Little et al.
7,183,076 B2 2/2007 Arathoon et al.
7,186,804 B2 3/2007 Gillies et al.
7,189,826 B2 3/2007 Rodman
7,250,297 B1 7/2007 Beste et al.
7,276,241 B2 10/2007 Schneider et al.
7,332,581 B2 2/2008 Presta
7,361,360 B2 4/2008 Kitabwalla et al.
7,371,826 B2 5/2008 Presta
7,402,314 B2 7/2008 Sherman
7,431,380 B1 10/2008 Buresh
7,476,724 B2 1/2009 Dennis et al.
7,498,298 B2 3/2009 Doronina et al.
7,501,121 B2 3/2009 Tchistiakova et al.
7,517,966 B2 4/2009 Moretta et al.
7,521,056 B2 4/2009 Chang et al.
7,521,541 B2 4/2009 Eigenbrot et al.
7,527,787 B2 5/2009 Chang et al.
7,527,791 B2 5/2009 Adams et al.
7,534,866 B2 5/2009 Chang et al.
7,563,441 B2 7/2009 Graus et al.
7,601,803 B1 10/2009 Fiedler et al.
7,612,181 B2 11/2009 Wu et al.
7,642,228 B2 1/2010 Carter et al.
7,700,739 B2 4/2010 Lacy et al.
7,741,446 B2 6/2010 Pardridge et al.
7,750,128 B2 7/2010 Gegg et al.
7,767,429 B2 8/2010 Bookbinder et al.
7,799,902 B2 9/2010 Browning et al.
7,803,376 B2 9/2010 Velardi et al.
7,807,160 B2 10/2010 Presta et al.
7,829,289 B2 11/2010 Lantz et al.
7,855,275 B2 12/2010 Eigenbrot et al.
7,858,759 B2 12/2010 Brandt et al.
7,906,118 B2 3/2011 Chang et al.
7,919,257 B2 4/2011 Hoogenboom et al.
7,943,743 B2 5/2011 Korman et al.
7,999,077 B2 8/2011 Pastan et al.
8,003,774 B2 8/2011 Stavenhagen et al.
8,008,449 B2 8/2011 Korman et al.
8,012,465 B2 9/2011 Elias et al.
8,034,326 B2 10/2011 Hjorth et al.
8,202,517 B2 6/2012 Bookbinder et al.
8,216,805 B2 7/2012 Carter et al.
8,227,577 B2 7/2012 Klein et al.
8,299,220 B2 10/2012 Dalla-Favera
8,354,509 B2 1/2013 Carven et al.
8,362,213 B2 1/2013 Elkins et al.
8,450,470 B2 5/2013 Bookbinder et al.
8,466,260 B2 6/2013 Elkins et al.
8,552,156 B2 10/2013 Takayanagi et al.
8,580,252 B2 11/2013 Bookbinder et al.

(56) References Cited

U.S. PATENT DOCUMENTS

| | | | |
|---|---|---|---|
| 8,586,713 | B2 | 11/2013 | Davis et al. |
| 8,592,562 | B2 | 11/2013 | Kannan et al. |
| 8,609,089 | B2 | 12/2013 | Langermann et al. |
| 8,617,545 | B2 | 12/2013 | Hsu et al. |
| 8,617,559 | B2 | 12/2013 | Elkins et al. |
| 8,658,135 | B2 | 2/2014 | O'Connor-Mccourt et al. |
| 8,703,132 | B2 | 4/2014 | Imhof-Jung et al. |
| 8,772,246 | B2 | 7/2014 | Bookbinder et al. |
| 8,790,895 | B2 | 7/2014 | Fiedler et al. |
| 8,821,883 | B2 | 9/2014 | Ambrose et al. |
| 8,846,042 | B2 | 9/2014 | Zhou |
| 8,871,912 | B2 | 10/2014 | Davis et al. |
| 8,920,776 | B2 | 12/2014 | Gaiger et al. |
| 8,945,571 | B2 | 2/2015 | Mossner et al. |
| 8,993,524 | B2 | 3/2015 | Bedi et al. |
| 9,000,130 | B2 | 4/2015 | Bhakta et al. |
| 9,034,324 | B2 | 5/2015 | Kalled et al. |
| 9,056,905 | B2 | 6/2015 | Olson et al. |
| 9,145,588 | B2 | 9/2015 | Throsby et al. |
| 9,200,060 | B2 | 12/2015 | Kannan et al. |
| 9,243,058 | B2 | 1/2016 | Armitage et al. |
| 9,309,311 | B2 | 4/2016 | Gurney et al. |
| 9,340,621 | B2 | 5/2016 | Kufer et al. |
| 9,358,286 | B2 | 6/2016 | De et al. |
| 9,359,437 | B2 | 6/2016 | Davis et al. |
| 9,382,323 | B2 | 7/2016 | Brinkmann et al. |
| 9,387,237 | B2 | 7/2016 | Kalled et al. |
| 9,416,187 | B2 | 8/2016 | Tedder et al. |
| 9,447,159 | B2 | 9/2016 | Ast et al. |
| 9,447,185 | B2 | 9/2016 | Romagne et al. |
| 9,545,086 | B2 | 1/2017 | Mackay et al. |
| 9,593,376 | B2 | 3/2017 | Zitvogel et al. |
| 9,663,577 | B2 | 5/2017 | Pierres et al. |
| 9,676,863 | B2 | 6/2017 | Lo |
| 9,833,476 | B2 | 12/2017 | Zhang et al. |
| 10,150,816 | B2 | 12/2018 | Abbot et al. |
| 10,294,300 | B2 | 5/2019 | Raum et al. |
| 10,308,721 | B2 | 6/2019 | Williams et al. |
| 10,478,509 | B2 | 11/2019 | Torgov et al. |
| 10,610,571 | B2 | 4/2020 | Ptacin et al. |
| 10,676,516 | B2 | 6/2020 | Viney et al. |
| 10,730,942 | B2 | 8/2020 | Pule et al. |
| 10,815,311 | B2 | 10/2020 | Wesche et al. |
| 11,033,634 | B2 | 6/2021 | Stull et al. |
| 11,291,721 | B2 | 4/2022 | Loew et al. |
| 11,292,838 | B2 | 4/2022 | Schendel et al. |
| 11,673,953 | B2 | 6/2023 | Zhang et al. |
| 11,692,031 | B2 | 7/2023 | Dahlhoff et al. |
| 11,845,797 | B2 | 12/2023 | Tan et al. |
| 11,965,025 | B2 | 4/2024 | Tan et al. |
| 12,152,073 | B2 | 11/2024 | Loew et al. |
| 12,247,060 | B2 | 3/2025 | Loew et al. |
| 12,286,477 | B2 | 4/2025 | Tan et al. |
| 12,351,632 | B2 | 7/2025 | Tan et al. |
| 12,358,982 | B2 | 7/2025 | Loew et al. |
| 12,384,842 | B2 | 8/2025 | Loew et al. |
| 12,486,326 | B2 | 12/2025 | Tan et al. |
| 2002/0004587 | A1 | 1/2002 | Miller et al. |
| 2002/0041865 | A1 | 4/2002 | Austin et al. |
| 2002/0062010 | A1 | 5/2002 | Arathoon et al. |
| 2002/0076406 | A1 | 6/2002 | Leung |
| 2002/0103345 | A1 | 8/2002 | Zhu |
| 2002/0115214 | A1 | 8/2002 | June et al. |
| 2002/0164328 | A1 | 11/2002 | Shinkawa et al. |
| 2003/0099647 | A1 | 5/2003 | Deshpande et al. |
| 2003/0115614 | A1 | 6/2003 | Kanda et al. |
| 2003/0130496 | A1 | 7/2003 | Winter et al. |
| 2003/0157108 | A1 | 8/2003 | Presta |
| 2003/0175884 | A1 | 9/2003 | Umana et al. |
| 2003/0207346 | A1 | 11/2003 | Arathoon et al. |
| 2003/0211078 | A1 | 11/2003 | Heavner |
| 2004/0009530 | A1 | 1/2004 | Wilson et al. |
| 2004/0093621 | A1 | 5/2004 | Shitara et al. |
| 2004/0109865 | A1 | 6/2004 | Niwa et al. |
| 2004/0110282 | A1 | 6/2004 | Kanda et al. |
| 2004/0110704 | A1 | 6/2004 | Yamane et al. |
| 2004/0132140 | A1 | 7/2004 | Satoh et al. |
| 2004/0175756 | A1 | 9/2004 | Kolkman et al. |
| 2004/0219643 | A1 | 11/2004 | Winter et al. |
| 2004/0220388 | A1 | 11/2004 | Mertens et al. |
| 2004/0241817 | A1 | 12/2004 | Umana et al. |
| 2004/0242847 | A1 | 12/2004 | Fukushima et al. |
| 2005/0003403 | A1 | 1/2005 | Rossi et al. |
| 2005/0004352 | A1 | 1/2005 | Kontermann et al. |
| 2005/0014934 | A1 | 1/2005 | Hinton et al. |
| 2005/0048512 | A1 | 3/2005 | Kolkman et al. |
| 2005/0053973 | A1 | 3/2005 | Kolkman et al. |
| 2005/0069552 | A1 | 3/2005 | Bleck et al. |
| 2005/0079170 | A1 | 4/2005 | Le Gall et al. |
| 2005/0079574 | A1 | 4/2005 | Bond |
| 2005/0090648 | A1 | 4/2005 | Tsurushita et al. |
| 2005/0100543 | A1 | 5/2005 | Hansen et al. |
| 2005/0119455 | A1 | 6/2005 | Fuh et al. |
| 2005/0123546 | A1 | 6/2005 | Umana et al. |
| 2005/0136049 | A1 | 6/2005 | Ledbetter et al. |
| 2005/0136051 | A1 | 6/2005 | Scallon |
| 2005/0163782 | A1 | 7/2005 | Glaser et al. |
| 2005/0260186 | A1 | 11/2005 | Bookbinder et al. |
| 2005/0266000 | A1 | 12/2005 | Bond et al. |
| 2005/0266425 | A1 | 12/2005 | Zauderer et al. |
| 2006/0008844 | A1 | 1/2006 | Stemmer et al. |
| 2006/0025576 | A1 | 2/2006 | Miller et al. |
| 2006/0083747 | A1 | 4/2006 | Winter et al. |
| 2006/0104968 | A1 | 5/2006 | Bookbinder et al. |
| 2006/0115832 | A1 | 6/2006 | Hoon |
| 2006/0120960 | A1 | 6/2006 | Deyev et al. |
| 2006/0141581 | A1 | 6/2006 | Gillies et al. |
| 2006/0204493 | A1 | 9/2006 | Huang et al. |
| 2006/0263367 | A1 | 11/2006 | Fey et al. |
| 2006/0275844 | A1 | 12/2006 | Linke et al. |
| 2007/0004909 | A1 | 1/2007 | Johnson et al. |
| 2007/0036783 | A1 | 2/2007 | Humeau et al. |
| 2007/0061900 | A1 | 3/2007 | Murphy et al. |
| 2007/0087381 | A1 | 4/2007 | Kojima |
| 2007/0105105 | A1 | 5/2007 | Clelland et al. |
| 2007/0117126 | A1 | 5/2007 | Sidhu et al. |
| 2007/0128150 | A1 | 6/2007 | Norman |
| 2007/0141049 | A1 | 6/2007 | Bredehorst et al. |
| 2007/0154901 | A1 | 7/2007 | Thogersen et al. |
| 2007/0160598 | A1 | 7/2007 | Dennis et al. |
| 2007/0178106 | A1 | 8/2007 | Romagne |
| 2007/0184052 | A1 | 8/2007 | Lin et al. |
| 2007/0231322 | A1 | 10/2007 | Romagne et al. |
| 2007/0237764 | A1 | 10/2007 | Birtalan et al. |
| 2007/0274985 | A1 | 11/2007 | Dubel et al. |
| 2007/0292936 | A1 | 12/2007 | Barthelemy et al. |
| 2008/0050370 | A1 | 2/2008 | Glaser et al. |
| 2008/0063717 | A1 | 3/2008 | Romagne et al. |
| 2008/0069820 | A1 | 3/2008 | Fuh et al. |
| 2008/0152645 | A1 | 6/2008 | Pardridge et al. |
| 2008/0171855 | A1 | 7/2008 | Rossi et al. |
| 2008/0241884 | A1 | 10/2008 | Shitara et al. |
| 2008/0247944 | A1 | 10/2008 | Graziano et al. |
| 2008/0254512 | A1 | 10/2008 | Capon |
| 2008/0260738 | A1 | 10/2008 | Moore et al. |
| 2008/0299137 | A1 | 12/2008 | Svendsen et al. |
| 2009/0002360 | A1 | 1/2009 | Chen et al. |
| 2009/0010843 | A1 | 1/2009 | Spee et al. |
| 2009/0130106 | A1 | 5/2009 | Christopherson et al. |
| 2009/0148905 | A1 | 6/2009 | Ashman et al. |
| 2009/0155275 | A1 | 6/2009 | Wu et al. |
| 2009/0162359 | A1 | 6/2009 | Klein et al. |
| 2009/0162360 | A1 | 6/2009 | Klein et al. |
| 2009/0175851 | A1 | 7/2009 | Klein et al. |
| 2009/0175867 | A1 | 7/2009 | Thompson et al. |
| 2009/0214533 | A1 | 8/2009 | Clynes |
| 2009/0232811 | A1 | 9/2009 | Klein et al. |
| 2009/0234105 | A1 | 9/2009 | Gervay-Hague et al. |
| 2009/0263392 | A1 | 10/2009 | Igawa et al. |
| 2009/0274649 | A1 | 11/2009 | Qu et al. |
| 2009/0280116 | A1 | 11/2009 | Smith et al. |
| 2009/0324538 | A1 | 12/2009 | Wong et al. |
| 2010/0015133 | A1 | 1/2010 | Igawa et al. |
| 2010/0015153 | A1 | 1/2010 | Moretta et al. |

(56) References Cited

U.S. PATENT DOCUMENTS

2010/0028330 A1 2/2010 Collins et al.
2010/0047169 A1 2/2010 Mandelboim et al.
2010/0168393 A1 7/2010 Clube et al.
2010/0260704 A1 10/2010 Berenguer et al.
2010/0316645 A1 12/2010 Imhof-Jung et al.
2011/0014659 A1 1/2011 Balazs et al.
2011/0054151 A1 3/2011 Lazar et al.
2011/0091372 A1 4/2011 Ghayur et al.
2011/0150892 A1 6/2011 Thudium et al.
2011/0177073 A1 7/2011 Van Berkel et al.
2011/0177093 A1 7/2011 Kalled et al.
2011/0250170 A1 10/2011 Pedretti et al.
2011/0287056 A1 11/2011 Gu et al.
2011/0293613 A1 12/2011 Brinkmann et al.
2012/0034221 A1 2/2012 Bonvini et al.
2012/0039906 A1 2/2012 Olive
2012/0114649 A1 5/2012 Langermann et al.
2012/0149876 A1 6/2012 Von Kreudenstein et al.
2012/0184716 A1 7/2012 Fischer et al.
2012/0201746 A1 8/2012 Liu et al.
2012/0213768 A1 8/2012 Oh et al.
2012/0294857 A1 11/2012 Sentman et al.
2013/0017200 A1 1/2013 Scheer et al.
2013/0022601 A1 1/2013 Brinkmann et al.
2013/0078249 A1 3/2013 Ast et al.
2013/0129723 A1 5/2013 Blankenship et al.
2013/0164293 A1 6/2013 Florio et al.
2013/0165638 A1 6/2013 Hsu et al.
2013/0178605 A1 7/2013 Blein et al.
2013/0195849 A1 8/2013 Spreter Von Kreudenstein et al.
2013/0243775 A1 9/2013 Papadopoulos et al.
2013/0266568 A1 10/2013 Brinkmann et al.
2013/0267686 A1 10/2013 Brinkmann et al.
2013/0273055 A1 10/2013 Borges et al.
2013/0273089 A1 10/2013 Getts et al.
2013/0280208 A1 10/2013 Stepkowski et al.
2013/0303396 A1 11/2013 Igawa et al.
2013/0317200 A1 11/2013 Elson et al.
2014/0037621 A1 2/2014 Tsurushita et al.
2014/0044728 A1 2/2014 Takayanagi et al.
2014/0051833 A1 2/2014 Fischer et al.
2014/0051835 A1 2/2014 Dixit et al.
2014/0072528 A1 3/2014 Gerdes et al.
2014/0072581 A1 3/2014 Dixit et al.
2014/0079689 A1 3/2014 Elliott et al.
2014/0079691 A1 3/2014 Mcconnell et al.
2014/0099254 A1 4/2014 Chang et al.
2014/0154254 A1 6/2014 Kannan et al.
2014/0199294 A1 7/2014 Mimoto et al.
2014/0200331 A1 7/2014 Corper et al.
2014/0227265 A1 8/2014 Wu et al.
2014/0242075 A1 8/2014 Parren et al.
2014/0242077 A1 8/2014 Choi et al.
2014/0256916 A1 9/2014 Kruip et al.
2014/0308285 A1 10/2014 Yan et al.
2014/0322212 A1 10/2014 Brogdon et al.
2014/0322221 A1 10/2014 Miller et al.
2014/0348839 A1 11/2014 Chowdhury et al.
2014/0363426 A1 12/2014 Moore et al.
2014/0377269 A1 12/2014 Mabry et al.
2015/0017187 A1 1/2015 Thanos et al.
2015/0018529 A1 1/2015 Humphreys et al.
2015/0056199 A1 2/2015 Kumar et al.
2015/0098900 A1 4/2015 Ebens et al.
2015/0133638 A1 5/2015 Wranik et al.
2015/0166661 A1 6/2015 Chen et al.
2015/0166670 A1 6/2015 Castoldi et al.
2015/0175707 A1 6/2015 De Jong et al.
2015/0203591 A1 7/2015 Yancopoulos et al.
2015/0211001 A1 7/2015 Ohrn et al.
2015/0218260 A1 8/2015 Klein et al.
2015/0232560 A1 8/2015 Heindl et al.
2015/0315296 A1 11/2015 Schaefer et al.
2015/0337049 A1 11/2015 Labrijn et al.
2015/0344570 A1 12/2015 Igawa et al.
2015/0353636 A1 12/2015 Parren et al.
2015/0368351 A1 12/2015 Vu et al.
2015/0368352 A1 12/2015 Liu
2015/0376287 A1 12/2015 Vu et al.
2016/0015749 A1 1/2016 Gottschalk et al.
2016/0039947 A1 2/2016 Demarest et al.
2016/0075785 A1 3/2016 Ast et al.
2016/0102135 A1 4/2016 Escobar-Cabrera
2016/0114057 A1 4/2016 Dixit et al.
2016/0130347 A1 5/2016 Bruenker et al.
2016/0131654 A1 5/2016 Berenson et al.
2016/0145340 A1 5/2016 Borges et al.
2016/0145354 A1 5/2016 Bacac et al.
2016/0176973 A1 6/2016 Kufer et al.
2016/0194389 A1 7/2016 Regula et al.
2016/0229915 A1 8/2016 Igawa et al.
2016/0244523 A1 8/2016 Blank et al.
2016/0257763 A1 9/2016 Von Kreudenstein et al.
2016/0264685 A1 9/2016 Fouque et al.
2016/0297885 A1 10/2016 Kuo et al.
2016/0311915 A1 10/2016 Pulé et al.
2016/0368985 A1 12/2016 Hotzel et al.
2016/0368988 A1 12/2016 Bakker et al.
2017/0022284 A1 1/2017 Timmer et al.
2017/0035905 A1 2/2017 Abrams et al.
2017/0037128 A1 2/2017 Little et al.
2017/0051068 A1 2/2017 Pillarisetti et al.
2017/0066827 A1 3/2017 Pulé et al.
2017/0151281 A1 6/2017 Wagner et al.
2017/0204176 A1 7/2017 Bonvini et al.
2017/0269092 A1 9/2017 Kralovics
2017/0275362 A1 9/2017 Brentjens et al.
2017/0298445 A1 10/2017 Ogg
2017/0334998 A1 11/2017 Pulé et al.
2017/0368169 A1 12/2017 Loew et al.
2018/0153938 A1 6/2018 Keating et al.
2018/0228906 A1 8/2018 Helin et al.
2018/0235887 A1 8/2018 Garidel et al.
2018/0256716 A1 9/2018 Schendel et al.
2019/0062448 A1 2/2019 Soros et al.
2019/0209612 A1 7/2019 Puléet al.
2019/0315883 A1 10/2019 Ast et al.
2019/0322763 A1 10/2019 Ast et al.
2020/0071417 A1 3/2020 Loew et al.
2020/0109195 A1 4/2020 Watkins et al.
2020/0129638 A1 4/2020 Van Berkel et al.
2020/0140549 A1 5/2020 Cordoba et al.
2020/0172591 A1 6/2020 Hosse et al.
2020/0172868 A1 6/2020 Wickham et al.
2020/0200756 A1 6/2020 Pulé et al.
2020/0230208 A1 7/2020 Wang et al.
2020/0277384 A1 9/2020 Chang et al.
2020/0291089 A1 9/2020 Loew et al.
2020/0299349 A1 9/2020 Garcia et al.
2020/0306301 A1 10/2020 Andresen et al.
2020/0308242 A1 10/2020 Lowe et al.
2020/0317787 A1 10/2020 Li et al.
2020/0332003 A1 10/2020 Britanova et al.
2020/0377571 A1 12/2020 Loew et al.
2020/0385472 A1 12/2020 Loew et al.
2021/0009711 A1 1/2021 Loew et al.
2021/0024631 A1 1/2021 Kley et al.
2021/0079114 A1 3/2021 Hudson
2021/0198369 A1 7/2021 Chang et al.
2021/0221863 A1 7/2021 Kang et al.
2021/0230311 A1 7/2021 Nezu et al.
2021/0246227 A1 8/2021 Loew et al.
2021/0277119 A1 9/2021 Tan et al.
2021/0363250 A1 11/2021 Kamikawaji et al.
2021/0380670 A1 12/2021 Loew et al.
2021/0380691 A1 12/2021 Loew et al.
2021/0380692 A1 12/2021 Loew et al.
2021/0380715 A1 12/2021 Yoshida et al.
2022/0064255 A1 3/2022 Loew et al.
2022/0064297 A1 3/2022 Tan et al.
2022/0112286 A1 4/2022 Britanova et al.
2022/0288200 A1 9/2022 Loew et al.
2022/0348963 A1 11/2022 Lee et al.
2023/0025484 A1 1/2023 Tan et al.

(56) References Cited

U.S. PATENT DOCUMENTS

| | | | |
|---|---|---|---|
| 2023/0031734 A1 | 2/2023 | Tan et al. |
| 2023/0034161 A1 | 2/2023 | Tan et al. |
| 2023/0048244 A1 | 2/2023 | Loew |
| 2023/0102344 A1 | 3/2023 | Katragadda et al. |
| 2023/0127740 A1 | 4/2023 | Tan et al. |
| 2023/0142522 A1 | 5/2023 | Tan et al. |
| 2023/0192848 A1 | 6/2023 | Loew |
| 2023/0227552 A1 | 7/2023 | Tan et al. |
| 2023/0265183 A1 | 8/2023 | Ren et al. |
| 2023/0333112 A1 | 10/2023 | Loew et al. |
| 2023/0348593 A1 | 11/2023 | Loew et al. |
| 2023/0374133 A1 | 11/2023 | Tan et al. |
| 2024/0002543 A1 | 1/2024 | Loew et al. |
| 2024/0301060 A1 | 9/2024 | Tan et al. |
| 2024/0400990 A1 | 12/2024 | Hayday et al. |
| 2024/0409636 A1 | 12/2024 | Hsu et al. |
| 2025/0011459 A1 | 1/2025 | Loew et al. |
| 2025/0074998 A1 | 3/2025 | Loew et al. |
| 2025/0099579 A1 | 3/2025 | Loew et al. |
| 2025/0215085 A1 | 7/2025 | Tan et al. |

FOREIGN PATENT DOCUMENTS

| | | | |
|---|---|---|---|
| CA | 3016563 | A1 | 9/2017 |
| CA | 3214757 | A1 | 10/2022 |
| CN | 101802010 | A | 8/2010 |
| CN | 101985476 | A | 3/2011 |
| CN | 104203981 | A | 12/2014 |
| CN | 104769103 | A | 7/2015 |
| CN | 105916876 | A | 8/2016 |
| CN | 106103475 | A | 11/2016 |
| CN | 106163547 | A | 11/2016 |
| CN | 107206024 | A | 9/2017 |
| CN | 107903325 | A | 4/2018 |
| CN | 108026171 | A | 5/2018 |
| CN | 108949698 | A | 12/2018 |
| CN | 109153728 | A | 1/2019 |
| CN | 113543807 | A | 10/2021 |
| CN | 114026122 | A | 2/2022 |
| DE | 10261223 | A1 | 7/2004 |
| EP | 0125023 | A1 | 11/1984 |
| EP | 0171496 | A2 | 2/1986 |
| EP | 0173494 | A2 | 3/1986 |
| EP | 0184187 | A2 | 6/1986 |
| EP | 0346087 | A2 | 12/1989 |
| EP | 0368684 | A1 | 5/1990 |
| EP | 0388151 | A1 | 9/1990 |
| EP | 0404097 | A2 | 12/1990 |
| EP | 0519596 | A1 | 12/1992 |
| EP | 0171496 | B1 | 5/1993 |
| EP | 0616640 | A1 | 9/1994 |
| EP | 0425235 | B1 | 9/1996 |
| EP | 0403156 | B1 | 9/1997 |
| EP | 1176195 | A1 | 1/2002 |
| EP | 0125023 | B2 | 3/2002 |
| EP | 0368684 | B2 | 9/2004 |
| EP | 0616640 | B1 | 9/2004 |
| EP | 1301605 | B1 | 11/2005 |
| EP | 1692172 | A2 | 8/2006 |
| EP | 1870459 | A1 | 12/2007 |
| EP | 2233501 | A1 | 9/2010 |
| EP | 2581113 | A1 | 4/2013 |
| EP | 1846020 | B1 | 8/2013 |
| EP | 2699259 | A1 | 2/2014 |
| EP | 2467165 | B1 | 1/2015 |
| EP | 2847231 | A1 | 3/2015 |
| EP | 2982694 | A1 | 2/2016 |
| EP | 3023437 | A1 | 5/2016 |
| EP | 1870459 | B1 | 6/2016 |
| EP | 2982694 | B1 | 6/2016 |
| EP | 3029068 | A1 | 6/2016 |
| EP | 2699259 | B1 | 7/2016 |
| EP | 3055329 | A1 | 8/2016 |
| EP | 3137500 | A1 | 3/2017 |
| EP | 3059246 | B1 | 7/2018 |
| EP | 2723380 | B1 | 8/2019 |
| EP | 3294768 | B1 | 8/2019 |
| EP | 3149031 | B1 | 12/2019 |
| EP | 3590967 | A1 | 1/2020 |
| EP | 3626739 | A1 | 3/2020 |
| EP | 3642228 | A1 | 4/2020 |
| EP | 3189132 | B1 | 6/2020 |
| EP | 3303392 | B1 | 8/2020 |
| EP | 4087871 | A1 | 11/2022 |
| GB | 2188638 | A | 10/1987 |
| GB | 2599228 | A | 3/2022 |
| GB | 2616354 | A | 9/2023 |
| JP | H0787994 | A | 4/1995 |
| JP | H08502246 | A | 3/1996 |
| JP | H09509307 | A | 9/1997 |
| JP | 2011524743 | A | 9/2011 |
| JP | 2013515509 | A | 5/2013 |
| JP | 2014527802 | A | 10/2014 |
| JP | 2016512557 | A | 4/2016 |
| JP | 2017143838 | A | 8/2017 |
| JP | 2018517712 | A | 7/2018 |
| JP | 6400470 | B2 | 10/2018 |
| JP | 2018531939 | A | 11/2018 |
| WO | WO-8500817 | A1 | 2/1985 |
| WO | WO-8601533 | A1 | 3/1986 |
| WO | WO-8702671 | A1 | 5/1987 |
| WO | WO-9002809 | A1 | 3/1990 |
| WO | WO-9100906 | A1 | 1/1991 |
| WO | WO-9103493 | A1 | 3/1991 |
| WO | WO-9110741 | A1 | 7/1991 |
| WO | WO-9117271 | A1 | 11/1991 |
| WO | WO-9201047 | A1 | 1/1992 |
| WO | WO-9203917 | A1 | 3/1992 |
| WO | WO-9203918 | A1 | 3/1992 |
| WO | WO-9209690 | A2 | 6/1992 |
| WO | WO-9215679 | A1 | 9/1992 |
| WO | WO-9218619 | A1 | 10/1992 |
| WO | WO-9220791 | A1 | 11/1992 |
| WO | WO-9209690 | A3 | 12/1992 |
| WO | WO-9301161 | A1 | 1/1993 |
| WO | WO-9301288 | A1 | 1/1993 |
| WO | WO-9308829 | A1 | 5/1993 |
| WO | WO-9311161 | A1 | 6/1993 |
| WO | WO-9311236 | A1 | 6/1993 |
| WO | WO-9323537 | A1 | 11/1993 |
| WO | WO-9404678 | A1 | 3/1994 |
| WO | WO-9405801 | A1 | 3/1994 |
| WO | WO-9409131 | A1 | 4/1994 |
| WO | WO-9411026 | A2 | 5/1994 |
| WO | WO-9412625 | A2 | 6/1994 |
| WO | WO-9425591 | A1 | 11/1994 |
| WO | WO-9429351 | A2 | 12/1994 |
| WO | WO-9509917 | A1 | 4/1995 |
| WO | WO-9516038 | A2 | 6/1995 |
| WO | WO-9637621 | A2 | 11/1996 |
| WO | WO-9730087 | A1 | 8/1997 |
| WO | WO-9814206 | A1 | 4/1998 |
| WO | WO-9856915 | A2 | 12/1998 |
| WO | WO-9858964 | A1 | 12/1998 |
| WO | WO-9904820 | A2 | 2/1999 |
| WO | WO-9916873 | A1 | 4/1999 |
| WO | WO-9922764 | A1 | 5/1999 |
| WO | WO-9945110 | A1 | 9/1999 |
| WO | WO-9951642 | A1 | 10/1999 |
| WO | WO-9964460 | A1 | 12/1999 |
| WO | WO-0006605 | A2 | 2/2000 |
| WO | WO-0034784 | A1 | 6/2000 |
| WO | WO-0060070 | A1 | 10/2000 |
| WO | WO-0061739 | A1 | 10/2000 |
| WO | WO-0104144 | A2 | 1/2001 |
| WO | WO-0129246 | A1 | 4/2001 |
| WO | WO-0136630 | A2 | 5/2001 |
| WO | WO-0164942 | A1 | 9/2001 |
| WO | WO-0198357 | A2 | 12/2001 |
| WO | WO-0231140 | A1 | 4/2002 |
| WO | WO-02070647 | A2 | 9/2002 |
| WO | WO-02072635 | A2 | 9/2002 |
| WO | WO-03002609 | A2 | 1/2003 |
| WO | WO-03011878 | A2 | 2/2003 |

(56) References Cited

FOREIGN PATENT DOCUMENTS

WO WO-03014161 A2 2/2003
WO WO-03056914 A1 7/2003
WO WO-03084570 A1 10/2003
WO WO-03085107 A1 10/2003
WO WO-03085119 A1 10/2003
WO WO-03093318 A1 11/2003
WO WO-2004003019 A2 1/2004
WO WO-2004024927 A1 3/2004
WO WO-2004033685 A1 4/2004
WO WO-2004056312 A2 7/2004
WO WO-2004056392 A1 7/2004
WO WO-2004056873 A1 7/2004
WO WO-2004057002 A2 7/2004
WO WO-2004058821 A2 7/2004
WO WO-2004065540 A2 8/2004
WO WO-2004081026 A2 9/2004
WO WO-2004081051 A1 9/2004
WO WO-2004101790 A1 11/2004
WO WO-2004106368 A1 12/2004
WO WO-2005035572 A2 4/2005
WO WO-2005035586 A1 4/2005
WO WO-2005035778 A1 4/2005
WO WO-2005053742 A1 6/2005
WO WO-2005100402 A1 10/2005
WO WO-2006000830 A2 1/2006
WO WO-2006020258 A2 2/2006
WO WO-2006029879 A2 3/2006
WO WO-2006044908 A2 4/2006
WO WO-2006079372 A1 8/2006
WO WO-2006106905 A1 10/2006
WO WO-2006121168 A1 11/2006
WO WO-2006135886 A2 12/2006
WO WO-2007005874 A2 1/2007
WO WO-2007044887 A2 4/2007
WO WO-2007059782 A1 5/2007
WO WO-2007005874 A3 7/2007
WO WO-2007095338 A2 8/2007
WO WO-2007110205 A2 10/2007
WO WO-2007137760 A2 12/2007
WO WO-2008017859 A2 2/2008
WO WO-2008077546 A1 7/2008
WO WO-2008087219 A1 7/2008
WO WO-2008119353 A1 10/2008
WO WO-2009021754 A2 2/2009
WO WO-2009068630 A1 6/2009
WO WO-2009077993 A2 6/2009
WO WO-2009089004 A1 7/2009
WO WO-2009101611 A1 8/2009
WO WO-2009103538 A1 8/2009
WO WO-2009114335 A2 9/2009
WO WO-2009147137 A1 12/2009
WO WO-2010019570 A2 2/2010
WO WO-2010027797 A1 3/2010
WO WO-2010027827 A2 3/2010
WO WO-2010029513 A2 3/2010
WO WO-2010077634 A1 7/2010
WO WO-2010129304 A2 11/2010
WO WO-2011066342 A2 6/2011
WO WO-2011090762 A1 7/2011
WO WO-2011131746 A2 10/2011
WO WO-2011155607 A1 12/2011
WO WO-2012079000 A1 6/2012
WO WO-2012088309 A1 6/2012
WO WO-2012107417 A1 8/2012
WO WO-2012131555 A2 10/2012
WO WO-2012138475 A1 10/2012
WO WO-2012143498 A1 10/2012
WO WO-2012170438 A2 12/2012
WO WO-2013019615 A2 2/2013
WO WO-2013033626 A2 3/2013
WO WO-2013037484 A2 3/2013
WO WO-2013060867 A2 5/2013
WO WO-2013079174 A1 6/2013
WO WO-2013103912 A1 7/2013
WO WO-2013170168 A1 11/2013
WO WO-2014008218 A1 1/2014
WO WO-2014100823 A1 6/2014
WO WO-2014159940 A1 10/2014
WO WO-2015052230 A1 4/2015
WO WO-2015066379 A2 5/2015
WO WO-2015095811 A2 6/2015
WO WO-2015107015 A1 7/2015
WO WO-2015107025 A1 7/2015
WO WO-2015107026 A1 7/2015
WO WO-2015121383 A1 8/2015
WO WO-2015127158 A1 8/2015
WO WO-2015132598 A1 9/2015
WO WO-2015164815 A1 10/2015
WO WO-2015166073 A1 11/2015
WO WO-2015181805 A1 12/2015
WO WO-2015197582 A1 12/2015
WO WO-2015197593 A1 12/2015
WO WO-2015197598 A2 12/2015
WO WO-2016016299 A1 2/2016
WO WO-2016019969 A1 2/2016
WO WO-2016026943 A1 2/2016
WO WO-2016033555 A1 3/2016
WO WO-2016071376 A2 5/2016
WO WO-2016071377 A1 5/2016
WO WO-2016079081 A1 5/2016
WO WO-2016087416 A1 6/2016
WO WO-2016087514 A1 6/2016
WO WO-2016087650 A1 6/2016
WO WO-2016090327 A2 6/2016
WO WO-2016110468 A1 7/2016
WO WO-2016110584 A1 7/2016
WO WO-2016115274 A1 7/2016
WO WO-2016118641 A1 7/2016
WO WO-2016168149 A1 10/2016
WO WO-2016180969 A1 11/2016
WO WO-2016193301 A1 12/2016
WO WO-2017021349 A1 2/2017
WO WO-2017021450 A1 2/2017
WO WO-2017037634 A1 3/2017
WO WO-2017040930 A2 3/2017
WO WO-2017055391 A1 4/2017
WO WO-2017059551 A1 4/2017
WO WO-2017062604 A1 4/2017
WO WO-2017077382 A1 5/2017
WO WO-2017134140 A1 8/2017
WO WO-2017165464 A1 9/2017
WO WO-2017167919 A1 10/2017
WO WO-2017180913 A2 10/2017
WO WO-2018057955 A1 3/2018
WO WO-2018067992 A1 4/2018
WO WO-2018098365 A2 5/2018
WO WO-2018144777 A2 8/2018
WO WO-2018201047 A1 11/2018
WO WO-2018224844 A1 12/2018
WO WO-2018237192 A1 12/2018
WO WO-2019005641 A1 1/2019
WO WO-2019035938 A1 2/2019
WO WO-2019040700 A1 2/2019
WO WO-2019040780 A1 2/2019
WO WO-2019055677 A1 3/2019
WO WO-2019067805 A1 4/2019
WO WO-2019086865 A1 5/2019
WO WO-2019101695 A1 5/2019
WO WO-2019132738 A1 7/2019
WO WO-2019139987 A1 7/2019
WO WO-2019158764 A1 8/2019
WO WO-2019178362 A1 9/2019
WO WO-2019178364 A2 9/2019
WO WO-2019178364 A3 10/2019
WO WO-2019191519 A1 10/2019
WO WO-2019222278 A1 11/2019
WO WO-2019226617 A1 11/2019
WO WO-2019231920 A1 12/2019
WO WO-2020005819 A1 1/2020
WO WO-2020010250 A2 1/2020
WO WO-2020018708 A1 1/2020
WO WO-2020010250 A3 2/2020
WO WO-2020025928 A1 2/2020
WO WO-2020057646 A1 3/2020

(56) References Cited

FOREIGN PATENT DOCUMENTS

| | | |
|---|---|---|
| WO | WO-2020082048 A1 | 4/2020 |
| WO | WO-2020084290 A1 | 4/2020 |
| WO | WO-2020086758 A1 | 4/2020 |
| WO | WO-2020088459 A1 | 5/2020 |
| WO | WO-2020089644 A1 | 5/2020 |
| WO | WO-2020091635 A2 | 5/2020 |
| WO | WO-2020106708 A1 | 5/2020 |
| WO | WO-2020139171 A1 | 7/2020 |
| WO | WO-2020139175 A2 | 7/2020 |
| WO | WO-2020142672 A2 | 7/2020 |
| WO | WO-2020142672 A3 | 8/2020 |
| WO | WO-2020172571 A1 | 8/2020 |
| WO | WO-2020172596 A1 | 8/2020 |
| WO | WO-2020172598 A1 | 8/2020 |
| WO | WO-2020172601 A1 | 8/2020 |
| WO | WO-2020172605 A1 | 8/2020 |
| WO | WO-2020174235 A1 | 9/2020 |
| WO | WO-2020183245 A2 | 9/2020 |
| WO | WO-2020249757 A1 | 12/2020 |
| WO | WO-2021089704 A1 | 5/2021 |
| WO | WO-2021097325 | 5/2021 |
| WO | WO-2021138407 A2 | 7/2021 |
| WO | WO-2021138474 A2 | 7/2021 |
| WO | WO-2021140190 A1 | 7/2021 |
| WO | WO-2021155112 A1 | 8/2021 |
| WO | WO-2021138474 A3 | 9/2021 |
| WO | WO-2021188454 A1 | 9/2021 |
| WO | WO-2021217085 A1 | 10/2021 |
| WO | WO-2022046920 A2 | 3/2022 |
| WO | WO-2022046922 A2 | 3/2022 |
| WO | WO-2022047046 A1 | 3/2022 |
| WO | WO-2022046920 A3 | 4/2022 |
| WO | WO-2022046922 A3 | 4/2022 |
| WO | WO-2022175413 A1 | 8/2022 |
| WO | WO-2022179580 A1 | 9/2022 |
| WO | WO-2022216993 A2 | 10/2022 |
| WO | WO-2022216993 A3 | 11/2022 |
| WO | WO-2022240688 A1 | 11/2022 |
| WO | WO-2023066336 A1 | 4/2023 |
| WO | WO-2023081412 A2 | 5/2023 |
| WO | WO-2023122206 A2 | 6/2023 |
| WO | WO-2023141297 A2 | 7/2023 |
| WO | WO-2023081412 A3 | 8/2023 |
| WO | WO-2023122206 A3 | 8/2023 |
| WO | WO-2023141297 A3 | 8/2023 |
| WO | WO-2023250485 A1 | 12/2023 |
| WO | WO-2024081329 A1 | 4/2024 |
| WO | WO-2024081381 A1 | 4/2024 |
| WO | WO-2024197082 A2 | 9/2024 |
| WO | WO-2024226532 A2 | 10/2024 |
| WO | WO-2024227109 A1 | 10/2024 |
| WO | WO-2024197082 A3 | 11/2024 |
| WO | WO-2024254611 A2 | 12/2024 |
| WO | WO-2024226532 A3 | 1/2025 |
| WO | WO-2024254611 A3 | 3/2025 |
| WO | WO-2025049771 A1 | 3/2025 |
| WO | WO-2025080685 A2 | 4/2025 |
| WO | WO-2025080685 A3 | 7/2025 |
| WO | WO-2025160458 A1 | 7/2025 |
| WO | WO-2025217371 A2 | 10/2025 |
| WO | WO-2025222063 A2 | 10/2025 |
| WO | WO-2025222066 A1 | 10/2025 |
| WO | WO-2025217371 A3 | 11/2025 |
| WO | WO-2025245071 A1 | 11/2025 |
| WO | WO-2025222063 A3 | 12/2025 |

OTHER PUBLICATIONS

Casset et al. "A peptide mimetic of an anti-CD4 monoclonal antibody by rational design", BBRC 2003, 307:198-205 (Year: 2003).*

Vajdos et al. "Comprehensive functional maps of the antigen-binding site of an anti-ErbB2 antibody obtained with shotgun scanning mutagenesis", J. Mol. Biol. (2002) 320, 415-428 (Year: 2002).*

Chen et al. "Selection and analysis of an optimized anti-VEGF antibody: crystal structure of an affinity-matured Fab in complex with antigen", J. Mol. Bio. (1999) 293, 865-881 (Year: 1999).*

Wu et al. "Humanization of a murine monoclonal antibody by simultaneous optimization of framework and CDR residues", J. Mol. Biol. (1999) 294, 151-162 (Year: 1999).*

Padlan et al. "Structure of an antibody-antigen complex: crystal structure of the HyHEL-10 Fab-lysozyme complex", PNAS 1989, 86: 5938-5942 (Year: 1989).*

The Merck Manuals Online Medical Library, [online]. Merck Research Laboratories, 2006-2007. [retrieved on Oct. 19, 2020]. < URL: https://www.merckmanuals.com/professional/hematology-and-oncology/overview-of-cancer/cellular-and-molecular-basis-of-cancer>. Cellular and Molecular Basis of Cancer (Year: 2020).*

Agata, Yasutoshi. et al. Expression of the PD-1 Antigen on the Surface of Stimulated Mouse T and B Lymphocytes. International Immunology 8(5):765-772 (1996).

Aggen, DH. et al. Single-chain VαVβ T-cell Receptors Function Without Mispairing With Endogenous TCR Chains. Gene Therapy 19(4):365-374 (2012).

Akers, Michael J. et al. Formulation Development of Protein Dosage Forms. Pharmaceutical Biotechnology 14:47-127 (2002).

Akers, Michael J., et al. Peptides and proteins as parenteral solutions. Pharmaceutical formulation development of peptides and proteins. London: Taylor & Francis. pp. 145-77.(2000).

Allison, A C. The Mode of Action of Immunological Adjuvants. Developments in Biological Standardization 92:3-11 (1998).

Almagro et al.: Progress and Challenges in the Design and Clinical Development of Antibodies for Cancer Therapy. Frontiers in immunology; 8, 1751 (2018) doi:10.3389/fimmu.2017.01751 https://www.frontiersin.org/articles/10.3389/fimmu.2017.01751/full.

Almagro, Juan C, and Johan Fransson. Humanization of Antibodies. Frontiers in Bioscience 13:1619-1633 (2008).

Anderson, et al. Anti-CD3 + IL-2-stimulated murine killer cells. In vitro generation and in vivo antitumor activity. J Immunol 142 (4): 1383-1394 (1989).

Baca, Manuel et al. Antibody Humanization Using Monovalent Phage Display. The Journal of Biological Chemistry 272(16):10678-10684 (1997).

Baker, Brian M. et al. Conversion of a T cell antagonist into an agonist by repairing a defect in the TCR/peptide/MHC interface: implications for TCR signaling. Immunity 13(4):475-484 (2000).

Barthelemy, Pierre A. et al. Comprehensive analysis of the factors contributing to the stability and solubility of autonomous human VH domains. The Journal of biological chemistry 283(6):3639-3654 (2008).

Batzer, Mark A. et al. Enhanced Evolutionary PCR Using Oligonucleotides With Inosine at the 3'-Terminus. Nucleic Acids Research 19(18):5081 (1991).

Baxevanis, Constantin N. Antibody-based cancer therapy. Expert Opinion on Drug Discovery 3(4):441-452 (2008).

Baxter, et al. Acquired mutation of the tyrosine kinase JAK2 in human myeloproliferative disorders. The Lancet. 2005. 365(9464):1054-1061.

Beiboer, Sigrid HW. et al. Guided selection of a pan carcinoma specific antibody reveals similar binding characteristics yet structural divergence between the original murine antibody and its human equivalent. Journal of Molecular Biology 296(3):833-849 (2000).

Benati, Daniela. et al. Public T Cell Receptors Confer High-avidity CD4 Responses to HIV Controllers. Journal of Clinical Investigation 126(6):2093-2108 (2016).

Bendig, Mary M. Humanization of rodent monoclonal antibodies by CDR grafting. Methods-Companion to Methods in Enzymology 8(2):83-93 (1995).

Benmebarek, et al., Killing Mechanisms of Chimeric Antigen Receptor (CAR) T Cells. International Journal of Molecular Sciences 20(6):1283 (2019).

Berge, Stephen M. et al. Pharmaceutical Salts. Journal of Pharmaceutical Sciences 66(1):1-19 (1977).

(56) References Cited

OTHER PUBLICATIONS

Biomunex Pharmaceuticals, "Disruptive biological approaches in immunotherapy, based on next generation BiXAb® bi-and multi-specific antibody platform for cancer treatment," Mar. 2023 [PowerPoint Slides].
Blank, Christian. et al. Interaction of PD-L1 on Tumor Cells with PD-1 on Tumor-Specific T cells as a Mechanism of Immune Evasion: Implications for Tumor Immunotherapy. Cancer Immunology, Immunotherapy 54(4):307-314 (2005). Published Online on Dec. 15, 2004.
Bloeman, PGM. et al. Adhesion Molecules: a New Target for Immunoliposome-mediated Drug Delivery. FEBS Letters 357:140-144 (1995).
Blythe, Martin J, and Darren R Flower. Benchmarking B cell epitope prediction: underperformance of existing methods. Protein science 14(1):246-248 (2005). Published online Dec. 2, 2004.
Boerner, Paula. et al. Production of Antigen-Specific Human Monoclonal Antibodies From in Vitro-primed Human Splenocytes. Journal of Immunology 147(1):86-95 (1991).
Boger, D. L., and Goldberg, J. Cytokine receptor dimerization and activation: prospects for small molecule agonists. Bioorganic & Medicinal chemistry 9(3): 557-562 (2001).
Bonsignori et al. Maturation Pathway from Germline to Broad HIV-1 Neutralizer of a CD4-Mimic Antibody. Cell 165(2):449-463 (2016).
Borrebaeck, Carl A K. Antibody Engineering, Second Edition. Oxford University Press: 1-11 (1995).
Bovay, Amandine. et al. T Cell Receptor Alpha Variable 12-2 Bias in the Immunodominant Response to Yellow Fever Virus. European Journal of Immunology 48(2):258-272 (2018).
Brennan, Maureen. et al. Preparation of Bispecific Antibodies by Chemical Recombination of Monoclonal Immunoglobulin G1 Fragments. Science 229(4708):81-83 (1985).
Brennan, Rebekah M. et al. Predictable Alphabeta T-cell Receptor Selection Toward an HLA-B*3501-restricted Human Cytomegalovirus Epitope. Journal of Virology 81(13):7269-7273 (2007).
Brey, et al. A GB/CD3 bispecific BiTE antibody construct for targeting Human Cytomegalovirus-infected cells. Sci Rep 28;8(1):17453 (2018). 12 pages.
Briscoe, Page. et al. Delivery of Superoxide Dismutase to Pulmonary Epithelium via pH-sensitive Liposomes. American Journal of Physiology 268(3 Pt 1): L374-L380 (1995).
British Medical Association. Definition of Polypeptide. p. 457. The British Medical Association Illustrated Medical Dictionary, First UK Edition, 2002, Dorling Kindersley, London, England.
Brodeur, Bernard R. et al. Monoclonal Antibody Production Techniques and Applications. New York: Marcel Dekker:51-63 (1987).
Buckland, et al. Fusion glycoprotein of measles virus: nucleotide sequence of the gene and comparison with other paramyxoviruses. Journal of General Virology 68(6):1695-1703 (1987).
Bulek, Anna M. et al. Structural Basis of Human β-cell Killing by CD8+ T cells in Type 1 Diabetes. Nature Immunology 13(3):283-289 (2012).
Burgess, Wilson H. et al. Possible dissociation of the heparin-binding and mitogenic activities of heparin-binding (acidic fibroblast) growth factor-1 from its receptor-binding activities by site-directed mutagenesis of a single lysine residue. The Journal of Cell Biology 111(5):2129-2138 (1990).
Caldas, Cristina. et al. Humanization of the anti-CD18 antibody 6.7: an unexpected effect of a framework residue in binding to antigen. Molecular immunology 39(15):941-952 (2003).
Campbell, Peter J. The long-term outlook for essential thrombocythemia. Mayo Clin Proc 81(2):157-8 (2006).
Campbell, Peter J. The myeloproliferative disorders. N Engl J Med 355(23):2452-66 (2006).
Campisi, Laura et al. Clonally Expanded CD8 T Cells Characterize Amyotrophic Lateral Sclerosis-4. Nature 606(7916):945-952 (2022).
Carnero Contentti, Edgar, et al. Mucosal-Associated Invariant T Cell Features and TCR Repertoire Characteristics During the Course of Multiple Sclerosis. Frontiers in Immunology 10:1-17 (2019).
Carter, Laura L. et al. PD-1: PD-L Inhibitory Pathway Affects both CD4(+) and CD8(+) T Cells and is Overcome by IL-2. European Journal of Immunology 32(3):634-643 (2002).
Carter, Paul. et al. Humanization of an Anti-p185HER2 Antibody for Human Cancer Therapy. PNAS USA 89(10):4285-4289 (1992).
Cazzola, Mario, and Robert Kralovics. From Janus Kinase 2 to Calreticulin: The Clinically Relevant Genomic Landscape of Myeloproliferative Neoplasms. Blood 123(24):3714-3719 (2014).
Chancellor, A. et al., "CD1b-restricted Gem T cell responses are modulated by *Mycobacterium tuberculosis* mycolic acid meromycolate chains," PNAS, 2017;114(51):E10956-E10964.
Chang, et al. Opportunities and challenges for TCR mimic antibodies in cancer therapy. Expert Opinion on Biological Therapy 16(8):979-987 (2016).
Chari, Ravi V.J. et al. Immunoconjugates Containing Novel Maytansinoids: Promising Anticancer Drugs. Cancer Research 52(1):127-131 (1992).
Charlton, Keith A. Expression and Isolation of Recombinant Antibody Fragments in *E. Coli.* Chapter 14. Methods in Molecular Biology 248:245-254 (2003).
Chen, Lan. et al. The T Cell Repertoires from Nickel Sensitized Joint Implant Failure Patients. International Journal of Molecular Sciences 22(5):2428, 1-13 (2021).
Chen, Yvonne et al. Selection and Analysis of an Optimized Anti-VEGF Antibody: Crystal Structure of an Affinity-matured Fab in Complex With Antigen. Journal of Molecular Biology 293(4):865-881 (1999).
Chiu, et al. Antibody Structure and Function: The Basis for Engineering Therapeutics. Antibodies 8(4):55 (2019). 80 pages.
Choi, Yangwon et al. A method for production of antibodies to human T-cell receptor beta-chain variable regions. Proc Natl Acad Sci USA 88(19):8357-8361 (1991).
Choi, Yoonjoo, and Charlotte M Deane. Predicting antibody complementarity determining region structures without classification. Molecular bioSystems 7(12):3327-3334 (2011).
Chowdhury, Partha S. Engineering Hot Spots for Affinity Enhancement of Antibodies. Methods in Molecular Biology 207:179-196 (2008).
ClinicalTrials.gov Identifier: NCT00001846. Collection and Distribution of Blood Components From Healthy Donors for In Vitro Research Use, Record created Nov. 3, 1999. pp. 1-10. [retrieved on Aug. 22, 2024] Available at URL: https://clinicaltrials.gov/study/NCT00001846.
ClinicalTrials.gov Identifier: NCT01004822. A Safety, Tolerability, and Pharmacokinetic Trial With CVX-241 in Patients With Advanced Solid Tumors, Record created Oct. 28, 2009. pp. 1-17. [retrieved on Jul. 12, 2024] Available at URL: https://clinicaltrials.gov/study/NCT01004822?cond=NCT01004822&rank=1.
ClinicalTrials.gov Identifier: NCT03427411. M7824 in Subjects With HPV Associated Malignancies, Record created Feb. 8, 2018. pp. 1-19. [retrieved on Aug. 22, 2024] Available at URL: https://clinicaltrials.gov/study/NCT03427411?term=NCT03427411&rank=1.
Clynes, Raphael et al. Fc Receptors Are Required in Passive and Active Immunity to Melanoma. Proceedings of the National Academy of Sciences of the United States of America 95(2):652-656 (1998).
Cole, David K. et al. Germ Line-governed Recognition of a Cancer Epitope by an Immunodominant Human T-cell Receptor. Journal of Biological Chemistry 284(40):27281-27289 (2009).
Connolly, James L. et al. Tumor Structure and Tumor Stroma Generation. 6th Edition. Holland-Frei Cancer Medicine :1-5 (2003).
Consonni, M. et al., "Human T cells engineered with a leukemia lipid-specific TCR enables donor-unrestricted recognition of CD1c-expressing leukemia," Nat Commun., 2021;12(1):4844.
Co-pending U.S. Appl. No. 19/175,269, inventors Bayliffe; Andrew et al., filed Apr. 10, 2025.
Co-pending U.S. Appl. No. 19/175,671, inventor Bayliffe; Andrew, filed Apr. 10, 2025.
Co-pending U.S. Appl. No. 19/208,873, inventors Loew; Andreas et al., filed May 15, 2025.
Co-pending U.S. Appl. No. 19/214,564, inventors Tan; Seng-Lai et al., filed May 21, 2025.

(56) References Cited

OTHER PUBLICATIONS

Co-pending U.S. Appl. No. 19/265,026, inventors Loew; Andreas et al., filed Jul. 10, 2025.
Couzi, Lionel et al. Antibody-dependent anti-cytomegalovirus activity of human Gamma delta T cells expressing CD16 (FcgammaRIIIa). Blood 119(6):1418-1427 (2012).
Cragg, Mark S, and Martin J Glennie et al. Antibody Specificity Controls in Vivo Effector Mechanisms of anti-CD20 Reagents. Blood 103(7):2738-2743 (2004).
Cragg, Mark S. et al. Complement-mediated Lysis by Anti-CD20 mAb Correlates with Segregation into Lipid Rafts. Blood 101(3):1045-1052 (2003).
Crowther, Michael D. et al. Genome-wide CRISPR-Cas9 Screening Reveals Ubiquitous T Cell Cancer Targeting via the Monomorphic MHC Class I-related Protein MR1. Nature Immunology 21(2):178-185 (2020).
Cunningham, Brian C. et al. High-resolution Epitope Mapping of hGH-receptor Interactions by Alanine-scanning Mutagenesis. Science 244(4908):1081-1085 (1989).
Dahal-Koirala, S. et al. TCR Sequencing of Single Cells Reactive to DQ2.5-glia-α2 and DQ2.5-glia-ω2 Reveals Clonal Expansion and Epitope-specific V-gene Usage. 9(3):587-596 (2016).
Dall'Acqua, William F. et al. Antibody Humanization by Framework Shuffling. Methods 36(1):43-60 (2005).
De Genst, Erwin. et al. Antibody Repertoire Development in Camelids. Developmental and Comparative Immunology 30(1-2):187-198 (2006).
Deak, Laura Codarri, et al., PD-1-cis IL-2R Agonism Yields Better Effectors from Stem-like CD8+ T Cells. Nature 610(7930):161-172 (2022).
Delhommeau, François. et al. Mutation in TET2 in Myeloid Cancers. N Engl J Med 360(22):2289-2301 (2009).
Desmyter, Aline. et al. Camelid Nanobodies: Killing Two Birds with One Stone. Current Opinion in Structural Biology 32:1-8 (2015).
Dimasi, Nazzareno. et al. The Design and Characterization of Oligospecific Antibodies for Simultaneous Targeting of Multiple Disease Mediators. Journal of Molecular Biology 393(3):672-692 (2009).
Diskin, Ron. et al. Increasing the Potency and Breadth of an HIV Antibody by Using Structure-based Rational Design. Science 334(6060):1289-1293 (2011).
Dondelinger, Mathieu. et al. Understanding the significance and implications of antibody numbering and antigen-binding surface/residue definition. Frontiers in Immunology 9(2278):1-15 (2018).
Dong, Haidong, and Lieping Chen. B7-H1 Pathway and its Role in the Evasion of Tumor Immunity. Journal of Molecular Medicine 81(5):281-287 (2003).
Draghi, et al. P530 Novel bispecific antibody targeting NKp30 receptor enhances NK-mediated killing activity against multiple myeloma cells and overcomes CD16A deficiency. Abstract. In Meeting Abstracts: 33rd Annual Meeting & Pre-Conference Programs of the Society for Immunotherapy of Cancer (STIC 2018). 8 pages.
Du, Jiamu. et al. Molecular basis of recognition of human osteopontin by 23C3, a potential therapeutic antibody for treatment of rheumatoid arthritis. Journal of molecular biology 382(4):835-842 (2008).
Dubowchik, Gene M. et al. Doxorubicin Immunoconjugates Containing Bivalent, Lysosomally-cleavable Dipeptide Linkages. Bioorganic & Medicinal Chemistry Letters 12(11):1529-1532 (2002).
Duncan, Alexander R, and Greg Winter. The Binding Site for C1q on IgG. Nature 332(6166):738-740 (1988).
Dupuis, Marc et al. Dendritic Cells Internalize Vaccine Adjuvant After Intramuscular Injection. Cell Immunology 186(1):18-27 (1998).
Edwards, Bryan M. et al. The Remarkable Flexibility of the Human Antibody Repertoire; Isolation of Over One Thousand Different Antibodies to a Single Protein, BLyS. Journal of Molecular Biology 334(1):103-118 (2003).
Ernst, et al. Inactivating mutations of the histone methyltransferase gene EZH2 in myeloid disorders. Nat Genet 42(8):722-6 (2010).
Fellouse, Frederic A. et al. Synthetic Antibodies From a Four-amino-acid Code: a Dominant Role for Tyrosine in Antigen Recognition. Proceedings of the National Academy of Sciences 24:101(34):12467-12472 (2004).
Fernandez-Sesma, Ana. et al. A bispecific antibody recognizing influenza A virus M2 protein redirects effector cells to inhibit virus replication in vitro. Journal of virology 70(7):4800-4804 (1996).
Ferrari De Andrade, et al. Natural killer cells are essential for the ability of BRAF inhibitors to control BRAFV600E-mutant metastatic melanoma. Cancer research 74(24):7298-7308 (2014).
Fix, J A. et al. Oral Controlled Release Technology for Peptides: Status and Future Prospects. Pharmaceutical research 13(12):1760-1764 (1996).
Flatman, Stephen. et al. Process Analytics for Purification of Monoclonal Antibodies. Journal of Chromatography 848:79-87 (2007). Published Online on Dec. 11, 2006.
Fontana, Angelo. et al. Probing the Partly Folded States of Proteins by Limited Proteolysis. Folding & Design 2(2):R17-R26 (1997).
Freeman, Gordon. et al. Engagement of the PD-1 Immunoinhibitory Receptor by a Novel B7 Family Member Leads to Negative Regulation of Lymphocyte Activation. Journal of Experimental Medicine 192(7):1027-1034 (2000).
Frick, Rahel et al. A TRAV26-1-encoded Recognition Motif Focuses the Biased T Cell Response in Celiac Disease. European Journal of Immunology 50(1):142-145 (2020).
Gabrilovich, D I. et al. IL-12 and Mutant P53 Peptide-Pulsed Dendritic Cells for the Specific Immunotherapy of Cancer. Journal of Immunotherapy with Emphasis on Tumor Immunology 19(6):414-418 (1996).
Gacerez, Albert T. et al. How Chimeric Antigen Receptor Design Affects Adoptive T Cell Therapy. Journal of cellular physiology 231(12):2590-2598 (2016).
Galvin, Teresa A. Effect of different promoters on immune responses elicited by HIV-1 gag/env multigenic DNA vaccine in Macaca mulatta and Macaca nemestrina. Vaccine 18(23):2566-2583 (2000).
Gamvrellis, Anita. et al. Vaccines That Facilitate Antigen Entry Into Dendritic Cells. Immunology & Cell Biology 82(5):506-516 (2004).
Gazzano-Santoro, Helene. et al. A Non-radioactive Complement-dependent Cytotoxicity Assay for Anti-cd20 Monoclonal Antibody. Journal of Immunological Methods 202(2):163-171 (1996).
Gedda, Mallikarjuna R. et al. Longitudinal transcriptional analysis of peripheral blood leukocytes in COVID-19 convalescent donors. J Transl Med 20(1):587, 1-16 (2022).
GenBank Accession No. 2ERJ_D. Version 2ERJ_D. Chain D, Interleukin-2. Record created Mar. 21, 2006. 2 pages. Retrieved Jul. 15, 2024 at URL: https://www.ncbi.nlm.nih.gov/protein/90109213.
GenBank Accession No. AAA62478.2. Version No. AAA62478.2. induced by lymphocyte activation; similar to Human receptor protein encoded by GenBank Accession No. U03397 [*Homo sapiens*]. Record created Jun. 12, 1993. 2 Pages. Retrieved Aug. 1, 2024 at URL: https://www.ncbi.nlm.nih.gov/protein/AAA62478.
GenBank Accession No. AAH66254. Version No. AAH66254.1. Interleukin 2 [*Homo sapiens*]. Record created Feb. 12, 2004. 2 Pages. Retrieved Jul. 12, 2024 at URL: https://www.ncbi.nlm.nih.gov/protein/AAH66254.
GenBank Accession No. BAG36664. Version No. BAG36664.1. unnamed protein product [*Homo sapiens*]. Record created May 23, 2008. 2 Pages. Retrieved Aug. 1, 2024 at URL: https://www.ncbi.nlm.nih.gov/protein/BAG36664.
GenBank Accession No. NM_005191. Version No. NM_005191.4. *Homo sapiens* CD80 Molecule (CD80), mRNA. Record created May 24, 1999. Retrieved Aug. 2, 2024. Retrieved from: https://www.ncbi.nlm.nih.gov/nuccore/NM_005191.
GenBank Accession No. NP002174. Version No. NP_002174.1. interleukin-3 receptor subunit alpha isoform 1 precursor [*Homo sapiens*]. Record created Mar. 14, 2021. 3 Pages. Retrieved Aug. 1, 2024 at URL: https://www.ncbi.nlm.nih.gov/protein/NP_002174.
George, Richard A, and Jaap Heringa. An analysis of protein domain linkers: their classification and role in protein folding. Protein engineering 15(11):871-879 (2002).
Gerngross, Tillman U. Advances in the Production of Human Therapeutic Proteins in Yeasts and Filamentous Fungi. Nature Biotechnology 22(11):1409-1414 (2004).

(56) References Cited

OTHER PUBLICATIONS

Gershoni, Jonathan M. et al. Epitope mapping: the first step in developing epitope-based vaccines. BioDrugs 21(3):145-156 (2007).
Gherardin, Nicholas A. et al. Human blood MAIT cell subsets defined using MR1 tetramers. Immunology and cell biology 96(5):507-525 (2018).
Giaccone, Giuseppe. et al. A phase I study of the natural killer T-cell ligand alpha-galactosylceramide (KRN7000) in patients with solid tumors. Clinical cancer research 8(12):3702-3709 (2002).
Godfrey, Dale I. et al. The Burgeoning Family of Unconventional T Cells. Nature Immunology 16(11):1114-1123 (2015).
Grabstein, et al. Cloning of a T cell growth factor that interacts with the β chain of the interleukin-2 receptor. Science 264(5161): 965-968 (1994).
Graham, Frank L. et al. Characteristics of a Human Cell line Transformed by DNA from Human Adenovirus type 5. Journal of General Virology 36(1):59-72 (1977).
Gruber, Meegan. et al. Efficient Tumor Cell Lysis Mediated by a Bispecific Single Chain Antibody Expressed in *Escherichia coli*. Journal of Immunology 152(11):5368-5374 (1994).
Gussow et al., Chapter 5: Humanization of Monoclonal Antibodies. Methods in Enzymology. 203:99-121 (1991).
Hamers-Casterman, C. et al. Naturally Occurring Antibodies Devoid of Light Chains. Nature 363(6428):446-448 (1993).
Harutyunyan, et al. p53 lesions in leukemic transformation. N Engl J Med 364(5):488-90 (2011).
Harutyunyan, et al. Rare germline variants in regions of loss of heterozygosity may influence clinical course of hematological malignancies. Leukemia 25(11):1782-4 (2011).
Hashimoto, M, et al., PD-1 Combination Therapy with IL-2 Modifies CD8+ T Cell Exhaustion Program. Nature 610(7930):173-181 (2022).
He, X.Y. et al. TRAV gene expression in PBMCs and TILs in patients with breast cancer analyzed by a DNA melting curve (FQ-PCR) technique for TCR a chain CDR3 spectratyping. Neoplasma 59(6):693-699 (2012).
Helliwell, P S, and W J Taylor. Classification and Diagnostic Criteria for Psoriatic Arthritis. Annals of the Rheumatic Diseases 64(Suppl 2):ii3-ii8 (2005).
Hinks, Timothy S. C. and Xia-Wei Zhang. MAIT Cell Activation and Functions. Frontiers in Immunology 11:1014, 1-10 (2020).
Hinman, Lois M. et al. Preparation and Characterization of Monoclonal Antibody Conjugates of the Calicheamicins: a Novel and Potent Family of Antitumor Antibiotics. Cancer Research 53(14):3336-3342 (1993).
Holliger, Philipp. et al. “Diabodies”: Small Bivalent and Bispecific Antibody Fragments. Proceedings of the National Academy of Sciences of the United States of America 90(14):6444-6448 (1993).
Holmström, M O. et al. The calreticulin (CALR) exon 9 mutations are promising targets for cancer immune therapy. Leukemia 32(2):429-437 (2018).
Holmström, Morten Orebo, and Hans Carl Hasselbalch. Cancer immune therapy for myeloid malignancies: present and future. Seminars in Immunopathology 41(1):97-109 (2019).
Holmstrom, M O. et al. The CALR Exon 9 Mutations Are Shared Neoantigens in Patients With Calr Mutant Chronic Myeloproliferative Neoplasms. Leukemia 30(12):2413-2416 (2016).
Hong, Sung Noh. et al. Reduced diversity of intestinal T-cell receptor repertoire in patients with Crohn’s disease. Frontiers in Cellular and Infection Microbiology 12:1-12 (2022).
Hoogenboom, Hennie R. et al. By-Passing Immunisation: Human Antibodies From Synthetic Repertoires of Germline VH Gene Segments Rearranged In Vitro. Journal of Molecular Biology 227(2):381-388 (1992).
Hoogenboom, Hennie R. Overview of Antibody Phage-display Technology and Its Applications. Methods in Molecular Biology 178:1-37 (2002).
Horna, Pedro et al. Utility of TRBC1 expression in the diagnosis of peripheral blood involvement by cutaneous T-cell lymphoma. Journal of Investigative Dermatology 141(4):821-829.e2 (2021).
Howson, Lauren J. et al. MAIT cell clonal expansion and TCR repertoire shaping in human volunteers challenged with *Salmonella paratyphi* A. Nat Commun 9(1):253, 1-11 (2018).
Hsu, Jonathan. et al. AT cell receptor β chain-directed antibody fusion molecule activates and expands subsets of T cells to promote antitumor activity. Science translational medicine 15(724):eadi0258, 1-18 (2023).
Hsu, Jonathan. et al. Supplementary Materials for: a T Cell Receptor β Chain-directed Antibody Fusion Molecule Activates and Expands Subsets of T Cells to Promote Antitumor Activity. Science Translational Medicine 15(724):eadi0258, 1-39 (2023).
Huang, Huang. et al. Select sequencing of clonally expanded CD8+ T cells reveals limits to clonal expansion. Proc Natl Acad Sci U S A 116(18):8995-9001 (2019).
Huang, Shuan Shian. et al. Transforming Growth Factor ? Peptide Antagonists and Their Conversion to Partial Agonists. Journal of Biological Chemistry 272(43):27155-27159 (1997).
Huda, Taha I. et al. Specific HLA Alleles, Paired With TCR V- and J-gene Segment Usage, Link to Distinct Multiple Myeloma Survival Rates. Leukemia & Lymphoma 62(7):1711-1720 (2021).
Hudson, Peter J, and Christelle Souriau. Engineered Antibodies. Nature Medicine 9(1):129-134 (2003).
Human NKp30/NCR3 Antibody. Catalog No. MAB1849. Clone 210845 was used by HLDA to establish CD designation. [Website] R&D Systems. Retrieved Jul. 27, 2024 at URL: https://www.rndsystems.com/products/human-nkp30-ncr3-antibody-210845_mab1849. 7 pages.
Human NKp30/NCR3 Antibody. Catalog No. MAB18491. Source: Monoclonal Mouse IgG2A Clone No. 210847. [Website] R&D Systems. Retrieved Nov. 23, 2023 at URL: https://www.rndsystems.com/products/human-nkp30-ncr3-antibody-210847_mab18491#productdetails. 6 pages.
Hussain, Khiyam. et al. 1392 An Atypical Central Memory like Phenotype Can be Induced in Human T Cells by Innate TCRa Engagement. J. Immuno Ther. Cancer 10(suppl 2):A1447 (2022).
Idusogie, Eshoe E. et al. Mapping of the C1q Binding Site on Rituxan, a Chimeric Antibody with a Human IgG1 Fc. The Journal of Immunology 164(8):4178-4184 (2000).
Imai-Nishiya, Harue. et al. Double Knockdown of Alpha1,6-fucosyltransferase (FUT8) and GDP-mannose 4,6-dehydratase (GMD) in Antibody-producing Cells: a New Strategy for Generating Fully Non-fucosylated Therapeutic Antibodies With Enhanced ADCC. BMC Biotechnology 7:84, 1-13 (2007).
International Search Report and Written Opinion issued in PCT/US2019/040592, mailed Jan. 3, 2020.
Ipilimumab. CAS 477202-00-9. chemicalbook.com [Website] Retrieved Oct. 8, 2024 at: https://www.chemicalbook.com/CASEN_477202-00-9.htm. 3 pages.
James, et al. A JAK2 mutation in myeloproliferative disorders: pathogenesis and therapeutic and scientific prospects. Trends Mol Med 11(12):546-54 (2005).
James, et al. A unique clonal JAK2 mutation leading to constitutive signalling causes polycythemia vera. Nature. 2005;434:1144-1148.
Janeway Jr, Charles A. et al. The rearrangement of antigen-receptor gene segments controls lymphocyte development. Immunobiology: the Immune System in Health and Disease. 5th Edition. New York: Garland Science. 1-17 (2001).
Jeffrey, Scott C. et al. Dipeptide-based Highly Potent Doxorubicin Antibody Conjugates. Bioorganic Medicinal Chemistry Letters 16(2):358-362 (2006).
Johnsson, Bo. et al. Comparison of Methods for Immobilization to Carboxymethyl Dextran Sensor Surfaces by Analysis of the Specific Activity of Monoclonal Antibodies. Journal of Molecular Recognition 8(1-2):125-131 (1995).
Johnsson, Bo. et al. Immobilization of Proteins to a Carboxymethyldextran-modified Gold Surface for Biospecific Interaction Analysis in Surface Plasmon Resonance Sensors. Analytical Biochemistry 198(2):268-277 (1991).
Jonsson, U. et al. Introducing a Biosensor Based Technology for Real-time Biospecific Interaction Analysis. Annals of Clinical Biology 51(1):19-26 (1993).

(56) References Cited

OTHER PUBLICATIONS

Jonsson, U. et al. Real-time Biospecific Interaction Analysis Using Surface Plasmon Resonance and a Sensor Chip Technology. BioTechniques 11(5):620-627 (1991).
Ju, G. et al. Conversion of the interleukin 1 receptor antagonist into an agonist by site-specific mutagenesis. Proceedings of the National Academy of Sciences 88(7):2658-2662 (1991).
Jung, S. et al. Prevention and therapy of experimental autoimmune neuritis by an antibody against T cell receptors-alpha/beta. Journal of immunology 148(12):3768-3775 (1992).
Kabat, Elvin A. et al. Sequences of Proteins of Immunological Interest. Fifth Edition, NIH Pub. No. 91-3242. Public Health Service, U.S. Department of Health and Human Services, National Institutes of Health: 647-669 (1991).
Kam, Nadine Wong Shi. et al. Carbon Nanotubes as Multifunctional Biological Transporters and Near-infrared Agents for Selective Cancer Cell Destruction. Proceedings of the National Academy of Sciences of the United States of America 102(33):11600-11605 (2005).
Kanda, Yutaka. et al. Comparison of Cell Lines for Stable Production of Fucose-negative Antibodies With Enhanced ADCC. Biotechnology and Bioengineering 94(4):680-688 (2006).
Karlin, Samuel, and Stephen F. Altschul. Applications and statistics for multiple high-scoring segments in molecular sequences. Proceedings of the National Academy of Sciences 90(12):5873-5877 (1993).
Kashmiri, Syed V S. et al. SDR Grafting—a New Approach to Antibody Humanization. Methods 36(1):25-34 (2005).
Kasmar, A.G. et al., "CD1b tetramers bind αβ T cell receptors to identify a mycobacterial glycolipid-reactive T cell repertoire in humans," J Exp Med., 2011;208(9):1741-1747.
Keinanen, A, and M L Laukkanen. Biosynthetic Lipid-tagging of Antibodies. FEBS letters 346(1):123-126 (1994).
Kiefer, Jonathan D, and Dario Neri. Immunocytokines and bispecific antibodies: two complementary strategies for the selective activation of immune cells at the tumor site. Immunological reviews 270(1):178-192 (2016). Publication data downloaded from the web Sep. 13, 2025.
Killion, J J, and I J Fidler. Systemic Targeting of Liposome-encapsulated Immunomodulators to Macrophages for Treatment of Cancer Metastasis. ImmunoMethods 4(3):273-279 (1994).
King, H Dalton. et al. Monoclonal Antibody Conjugates of Doxorubicin Prepared With Branched Peptide Linkers: Inhibition of Aggregation by Methoxytriethyleneglycol Chains. Journal of Medicinal Chemistry 45(19):4336-4343 (2002).
Klampfl, Thorsten. et al. Genome Integrity of Myeloproliferative Neoplasms in Chronic Phase and During Disease Progression. Blood 118(1):167-176 (2011).
Klimka, A. et al. Human Anti-CD30 Recombinant Antibodies by Guided Phage Antibody Selection Using Cell Panning. British Journal of Cancer 83(2):252-260 (2000).
Knappik, et al. Fully synthetic human combinatorial antibody libraries (HuCAL) based on modular consensus frameworks and CDRs randomized with trinucleotides. J Mol Biol. Feb. 11, 2000;296(1):57-86.
Konishi, Jun. et al. B7-H1 Expression on Non-small Cell Lung Cancer Cells and Its Relationship With Tumor-infiltrating Lymphocytes and Their PD-1 Expression. Clinical Cancer Research 10(15):5094-5100 (2004).
Kostelny, S A. et al. Formation of a Bispecific Antibody by the Use of Leucine Zippers. Journal of Immunology 148(5):1547-1553 (1992).
Kozbor, D. et al. A Human Hybrid Myeloma for Production of Human Monoclonal Antibodies. Journal of Immunology 133(6):3001-3005 (1984).
Kralovics, et al. Altered gene expression in myeloproliferative disorders correlates with activation of signaling by the V617F mutation of Jak2. Blood 106(10):3374-6 (2005).
Kralovics, et al. Molecular pathogenesis of Philadelphia chromosome negative myeloproliferative disorders. Blood Rev 19(1):1-13 (2005).
Kralovics, Robert. et al. A Gain-of-function Mutation of JAK2 in Myeloproliferative Disorders. The New England Journal of Medicine 352(17):1779-1790 (2005).
Kralovics, Robert. Genetic Complexity of Myeloproliferative Neoplasms. Leukemia 22(10):1841-1848 (2008).
Kratz, F. et al. Prodrugs of Anthracyclines in Cancer Chemotherapy. Current Medicinal Chemistry 13(5):477-523 (2006).
Kriegsmann, Katharina. et al. NKT cells—New players in CAR cell immunotherapy? European Journal of Haematology 101(6):750-757 (2018).
Kronenberg, M et al., "A 'Gem' of a cell," Nat Immunol., 2013;14(7):694-695.
Kunik, Vered. et al. Structural consensus among antibodies defines the antigen binding site. PLoS computational biology 8(2):e1002388, 1-12 (2012).
Ladner, Robert C. Mapping the epitopes of antibodies. Biotechnology and genetic engineering reviews 24(1):1-30 (2007).
Latchman, Yvette. et al. PD-L2 is a Second Ligand for PD-1 and Inhibits T Cell Activation. Nature Immunology 2(3):261-268 (2001).
Lazar, Eliane. et al. Transforming growth factor alpha: mutation of aspartic acid 47 and leucine 48 results in different biological activities. Molecular and Cellular Biology 8(3):1247-1252 (1988).
Lee, Chingwei V. et al. Bivalent Antibody Phage Display Mimics Natural Immunoglobulin. Journal of Immunological Methods 284(1-2):119-132 (2004).
Lee, Chingwei V. et al. High-affinity Human Antibodies From Phage-displayed Synthetic Fab Libraries With a Single Framework Scaffold. Journal of Molecular Biology 340(5):1073-1093 (2004).
Lepore, Marco. et al. Functionally Diverse Human T cells Recognize non-microbial Antigens Presented by MR1.Elife 6:e24476, 1-22 (2017).
Levine, et al. The JAK2V617F activating mutation occurs in chronic myelomonocytic leukemia and acute myeloid leukemia, but not in acute lymphoblastic leukemia or chronic lymphocytic leukemia. Blood 106(10):3377-9 (2005).
Levine, Ross L. et al. Activating Mutation in the Tyrosine Kinase JAK2 in Polycythemia Vera, Essential Thrombocythemia, and Myeloid Metaplasia With Myelofibrosis. Cancer Cell 7(4):387-397 (2005).
Li, Huijuan. et al. Optimization of Humanized IgGs in Glycoengineered Pichia Pastoris. Nature Biotechnology 24(2):210-215 (2006).
Li, Jian. et al. Human Antibodies for Immunotherapy Development Generated via a Human B Cell Hybridoma Technology. Proceedings of the National Academy of Sciences of the United States of America 103(10):3557-3562 (2006).
Li, Yangqiu. et al. Restricted TRBV repertoire in CD4+ and CD8+ T-cell subsets from CML patients. Hematology 16(1):43-49 (2011).
Lifely, M R. et al. Glycosylation and biological activity of CAMPATH-1H Expressed in different Cell lines and Grown under different Culture Conditions. Glycobiology 5(8):813-822 (1995).
Lin, Yuan. et al. Improved Affinity of a Chicken Single-chain Antibody to Avian Infectious Bronchitis Virus by Site-directed Mutagenesis of Complementarity-determining Region H3. African Journal of Biotechnology 10(79):18294-18302 (2011).
Lode, Holger N. et al. Targeted Therapy With a Novel Enediyene Antibiotic Calicheamicin Theta(I)1 Effectively Suppresses Growth and Dissemination of Liver Metastases in a Syngeneic Model of Murine Neuroblastoma. Cancer Research 58(14):2925-2928 (1998).
Lonberg, Nils. Fully Human Antibodies From Transgenic Mouse and Phage Display Platforms. Current Opinion in Immunology 20(4):450-459 (2008).
Lonberg, Nils. Human Antibodies From Transgenic Animals. Nature Biotechnology 23(9):1117-1125 (2005).
Lopez, K. et al., "CD1b Tetramers Broadly Detect T Cells That Correlate With Mycobacterial Exposure but Not Tuberculosis Disease State," Front Immunol., 2020; 11:199.
Lossius, Andreas. et al. High-throughput Sequencing of TCR Repertoires in Multiple Sclerosis Reveals Intrathecal Enrichment of EBV-reactive CD8+ T Cells. European of Journal Immunology 44(11):3439-3452 (2014).

(56) References Cited

OTHER PUBLICATIONS

Lothstein, Katherine. et al. Abstract 1425: Epigenetic Modulation Synergizes with a Novel TCR B Chain Directed Antibody-fusion Molecule to Suppress Checkpoint-refractory Tumors Irrespective of MHCI Status. Cancer Research 84 (6_Supplement):1425, 1-2 (2024).
Lu, Chenyang. et al. Clinical Significance of T Cell Receptor Repertoire in Primary Sjogren's Syndrome. EBioMedicine 84:104252, 1-12 (2022).
Lydard, Peter. et al. In Antibodies: Generation of diversity. Immunology :76-85 (2011).
Maciocia, Paul M. et al. Supplemental Figures: Targeting the T cell receptor B-chain constant region for immunotherapy of T cell malignancies. Nature Medicine 23(12):1416-1423 (2017). Retrieved Oct. 8, 2024 at URL: https://static-content.springer.com/esm/art%3A10.1038%2Fnm.4444/MediaObjects/41591_2017_BFnm4444_MOESM1_ESM.pdf. 6 pages.
Maeda, T. et al. Amelioration of acute graft-versus-host disease and re-establishment of tolerance by short-term treatment with an anti-TCR antibody. Journal of immunology 153(9):4311-4320 (1994).
Makins, Marian, ed. Definition of Polypeptide. p. 1207. Collins English Dictionary, Third Edition, Updated 1995, HarperCollins Publishers, Glasgow, Scotland.
Marengo Therapeutics. Activating T-cells to Fight Cancer. Nature: B29 (2022).
Marks, James D, and Andrew Bradbury. Selection of Human Antibodies From Phage Display Libraries. Methods in Molecular Biology 48:161-176 (2004).
Marks, James D. et al. By-passing Immunization Human Antibodies from V-gene Libraries Displayed on Phage. Journal of Molecular Biology 222(3):581-597 (1991).
Martin, Andrew CR. Protein Sequence and Structure Analysis of Antibody Variable Domains. Antibody Engineering:422-439 (2001).
Martindale, Diane. et al. Length of huntingtin and its polyglutamine tract influences localization and frequency of intracellular aggregates. Nature genetics 18(2):150-154 (1998).
Matsumoto, Y. et al. Successful prevention and treatment of autoimmune encephalomyelitis by short-term administration of anti-T-cell receptor alpha beta antibody. Immunology 81(1):1-7 (1994).
Mayer, Gene. et al. Chapter 10: Major Histocompatibility Complex (MHC) and T-Cell Receptors—Role in Immune Responses. in: Microbiology and Immunology on-line, University of South Carolina School of Medicine: 1-6 (2010).
McCafferty, J. et al. Phage Antibodies: Filamentous Phage Displaying Antibody Variable Domains. Nature 348(6301):552-554 (1990).
McGoff, Paul, and David S. Scher. Solution Formulation of Proteins/Peptides:in McNally EJ., ed, Protein Formulation and Delivery:139-158 (2000).
McLaughlin-Taylor, Elizabeth. et al. Identification of the major late human cytomegalovirus matrix protein pp65 as a target antigen for CD8+ virus-specific cytotoxic T lymphocytes. Journal of medical virology 43(1):103-110 (1994).
McLellan, Jason S et al. Structure of HIV-1 gp120 V1/V2 Domain with Broadly Neutralizing Antibody PG9. Nature 480(7377):336-343 (2011).
Meermeier, Erin W. et al. Human TRAV1-2-negative MR1-restricted T cells detect S. pyogenes and alternatives to MAIT riboflavin-based antigens. Nat Commun 7:12506, 1-12 (2016).
Meeting Abstracts. 33rd Annual Meeting & Pre-Conference Programs of the Society for Immunotherapy of Cancer (SITC 2018). Journal for Immunotherapy of Cancer 6(Suppl 1): No. 115, pp. 207-398 (2018).
Meilleur, Courtney. et al. Bacterial Superantigens Expand and Activate, Rather than Delete or Incapacitate, Preexisting Antigen-Specific Memory CD8+ T Cells. J Infect Dis 219(8):1307-1317 (2019). Published online Nov. 12, 2018.
Milosevic, Jelena D, and Robert Kralovics. Genetic and Epigenetic Alterations of Myeloproliferative Disorders. International Journal of Hematology 97(2):183-197 (2013). Published Online Dec. 12, 2012.
Milstein, C, and A C Cuello. Hybrid Hybridomas and Their Use in Immunohistochemistry. Nature 305(5934):537-540 (1983).
Montrose-Rafizadeh, Chahrzad. et al. High potency antagonists of the pancreatic glucagon-like peptide-1 receptor. Journal of Biological Chemistry 272(34):21201-21206 (1997).
Moore, et al. Abstract C180: a novel bispecific platform for potent redirected killing of B-cell lymphoma. Mol Cancer Ther 8 (12_Supplement): C180 (2009).
Mosca, Paul J. et al. Dendritic cell vaccines. Frontiers in Bioscience 12:4050-4060 (2007).
Motozono, Chihiro. et al. Molecular Basis of a Dominant T Cell Response to an HIV Reverse Transcriptase 8-mer Epitope Presented by the Protective Allele HLA-B*51:01. Journal of Immunology 192(7):3428-3434 (2014).
Myers, et al. Optimal alignments in linear space. CABIOS 4(1):11-17 (1988).
Nagy, Attila. et al. Stability of Cytotoxic Luteinizing Hormone-releasing Hormone Conjugate (AN-152) Containing Doxorubicin 14-O-Hemiglutarate in Mouse and Human Serum in vitro: Implications for the Design of Preclinical Studies. Proc Natl Acad Sci U S A 97(2):829-834 (2000).
Nair et al., Epitope Recognition by Diverse Antibodies Suggests Conformational Convergence in an Antibody Response. The Journal of Immunology, 168:2371-2382 (2002).
Natsume, Akito et al. Engineered Antibodies of IgG1/IgG3 Mixed Isotype with Enhanced Cytotoxic Activities. Cancer Research 68(10):3863-3872 (2008).
Ni, Jian. Research Progress and Prospects of Antibodyomics and Antibody-Based Drugs, Modern Immunology 26(4):265-268 (2006). Abstract Only. One page.
Nomoto, K. et al. Tolerance induction in a fully allogeneic combination using anti-T cell receptor-alpha beta monoclonal antibody, low dose irradiation, and donor bone marrow transfusion. Transplantation 59(3):395-401 (1995).
Nonaka, Takashi. et al. Truncation and pathogenic mutations facilitate the formation of intracellular aggregates of TDP-43. Human molecular genetics 18(18):3353-3364 (2009).
Ohtsuka, Eiko et al. An Alternative Approach to Deoxyoligonucleotides as Hybridization Probes by Insertion of Deoxyinosine at Ambiguous Codon Positions. Journal of Biological Chemistry 260(5):2605-2608 (1985).
Okazaki, Akira. et al. Fucose Depletion From Human IgG1 Oligosaccharide Enhances Binding Enthalpy and Association Rate Between IgG1 and FcgammaRIIIa. Journal of Molecular Biology 336(5):1239-1249 (2004).
Osbourn, Jane. et al. From Rodent Reagents to Human Therapeutics Using Antibody Guided Selection. Methods 36(1):61-68 (2005).
Owais, Mohammad. et al. Chloroquine Encapsulated in Malaria-infected Erythrocyte-specific Antibody-bearing Liposomes Effectively Controls Chloroquine-resistant Plasmodium Berghei Infections in Mice. Antimicrobial Agents and Chemotherapy 39(1):180-184 (1995).
Padlan, Eduardo A. A Possible Procedure for Reducing the Immunogenicity of Antibody Variable Domains While Preserving Their Ligand-binding Properties. Molecular Immunology 28(4-5):489-498 (1991).
Panka et al. Variable region framework differences result in decreased or increased affinity of variant anti-digoxin antibodies. PNAS USA 85:3080-3084 (1988).
Pardanani, Animesh D. et al. MPL515 Mutations in Myeloproliferative and Other Myeloid Disorders: a Study of 1182 Patients. Blood 108(10):3472-3476 (2006).
Pardanani, et al. Discordant distribution of JAK2V617F mutation in siblings with familial myeloproliferative disorders. Blood 107(11):4572-3 (2006).
Paul, William E. et al. Chapter 8: Fundamental Immunology. 3rd Edition Raven Press New York :292-295 (1993).
PCT/US2018/029951 International Search Report and Written Opinion dated Jul. 3, 2018.
PCT/US2020/019329 International Search Report and Written Opinion dated Jun. 26, 2020.
PCT/US2021/047574 International Search Report and Written Opinion dated Feb. 17, 2022.

(56) References Cited

OTHER PUBLICATIONS

PCT/US2021/047773 International Search Report and Written Opinion dated Dec. 23, 2021.
PCT/US2022/023922 International Search Report and Written Opinion dated Oct. 6, 2022.
PCT/US2022/049039 International Search Report and Written Opinion dated May 10, 2023.
PCT/US2022/053705 International Search Report and Written Opinion dated Jul. 7, 2023.
PCT/US2023/011280 International Search Report and Written Opinion dated Jun. 28, 2023.
PCT/US2023/034966 International Search Report and Written Opinion dated Mar. 29, 2024.
PCT/US2023/035056 International Search Report and Written Opinion dated Mar. 5, 2024.
PCT/US2024/020796 International Search Report and Written Opinion dated Aug. 8, 2024.
PCT/US2024/025875 International Search Report and Written Opinion dated Dec. 17, 2024.
PCT/US2024/026686 International Search Report and Written Opinion dated Sep. 23, 2024.
PCT/US2024/033300 International Search Report and Written Opinion dated Jan. 29, 2025.
PCT/US2024/044469 International Search Report and Written Opinion dated Feb. 14, 2025.
PCT/US2024/050538 International Search Report and Written Opinion dated Jun. 4, 2025.
PCT/US2025/013029 International Search Report and Written Opinion dated Jun. 11, 2025.
PCT/US2025/030133 International Search Report and Written Opinion dated Sep. 15, 2025.
Pearson, William R. et al. Improved Tools for Biological Sequence Comparison. PNAS USA 85(8):2444-2448 (1988).
Pejchal, Robert. et al. A Potent and Broad Neutralizing Antibody Recognizes and Penetrates the HIV Glycan Shield. Science 334(6059):1097-1103 (2011).
Petersen, Jan. et al. Diverse T Cell Receptor Gene Usage in HLA-DQ8-associated Celiac Disease Converges Into a Consensus Binding Solution. Structure 24(10):1643-1657 (2016).
Petkova, Stefka B. et al. Enhanced Half-life of Genetically Engineered Human IgG1 Antibodies in a Humanized FcRn Mouse Model: Potential Application in Humorally Mediated Autoimmune Disease. International Immunology 18(12):1759-1769 (2006).
Pikman, et al. MPLW515L Is a Novel Somatic Activating Mutation in Myelofibrosis with Myeloid Metaplasia. PLoS Med. 2006;3(7):e270.
Pluckthun, A. Chapter 11: Antibodies From *Escherichia coli*. The Pharmacology of Monoclonal Antibodies 113:269-315 (1994).
Porritt, Rebecca A. et al. HLA Class I-associated Expansion of TRBV11-2 T Cells in Multisystem Inflammatory Syndrome in Children. The Journal of Clinical Investigation 131(10):e146614, 1-13 (2021).
Presta, Leonard G. et al. Humanization of an Antibody Directed Against IgE. Journal of Immunology 151(5): 2623-2632 (1993).
Presta, Leonard G. et al. Humanization of an Anti-vascular Endothelial Growth Factor Monoclonal Antibody for the Therapy of Solid Tumors and Other Disorders. Cancer Research 57(20):4593-4599 (1997).
Queen, Cary et al. A Humanized Antibody That Binds to the Interleukin 2 Receptor. PNAS USA 86(24):10029-10033 (1989).
Ranade, Vasant V. Drug Delivery Systems. 1. Site-specific Drug Delivery Using Liposomes as Carriers. Journal of Clinical Pharmacology 29(8):685-694 (1989).
Reinink, P. et al., "A Tcr β-Chain Motif Biases toward Recognition of Human CD1 Proteins," J Immunol., 2019;203(12):3395-3406.
Ripka, James. et al. Two Chinese Hamster Ovary Glycosylation Mutants Affected in the Conversion of GDP-mannose to GDP-fucose. Archives of Biochemistry and Biophysics 249(2):533-545 (1986).
Rosok, Mae Joanne. et al. A Combinatorial Library Strategy for the Rapid Humanization of Anticarcinoma BR96 Fab. The Journal of Biological Chemistry 271(37):22611-22618 (1996).
Rossolini, Gian Maria et al. Use of Deoxyinosine-containing Primers vs Degenerate Primers for Polymerase Chain Reaction Based on Ambiguous Sequence Information. Molecular and Cellular Probes 8(2):91-98 (1994).
Rowntree, Louise C. et al. A Shared TCR Bias Toward an Immunogenic EBV Epitope Dominates in HLA-B*07:02-Expressing Individuals. Journal of Immunology 205(6):1524-1534 (2020).
Samanen, James. et al. Chemical Approaches to Improve the Oral Bioavailability of Peptidergic Molecules. Journal of Pharmacy and Pharmacology 48(2):119-135 (1996).
Sanchez-Ruiz, Jose M. et al. Differential Scanning Calorimetry of the Irreversible Thermal Denaturation of Thermolysin. Biochemistry 27(5):1648-1652 (1988).
Schachter, Harry. et al. Biosynthetic Controls that Determine the Branching and Microheterogeneity of Protein-bound Oligosaccharides. Biochemistry and Cell Biology 64(3):163-181 (1986).
Scheid, Johannes F. et al. Sequence and Structural Convergence of Broad and Potent HIV Antibodies that Mimic CD4 Binding. Science 333(6049):1633-1637 (2011).
Scheuermann, R.H. and Racila, E. CD19 Antigen in Leukemia and Lymphoma Diagnosis and Immunotherapy. Leukemia & Lymphoma 18(5-6):385-397 (1995).
Schreiber, Andreas. et al. 3D-Epitope-Explorer (3DEX): localization of conformational epitopes within three-dimensional structures of proteins. Journal of computational chemistry 26(9):879-887 (2005).
Schreier, Hans. et al. Targeting of Liposomes to Cells Expressing CD4 Using Glycosylphosphatidylinositol-anchored gp120. Influence of Liposome Composition on Intracellular Trafficking. The Journal of Biological Chemistry 269(12):9090-9098 (1994).
Scott, et al. JAK2 exon 12 mutations in polycythemia vera and idiopathic erythrocytosis. N Engl J Med 356(5):459-68 (2007).
Sela-Culang, Inbal et al. The structural basis of antibody-antigen recognition. Frontiers in immunology 4:302, 1-13 (2013).
Shields, Robert L. et al. High Resolution Mapping of the Binding Site on Human IgG1 for Fc Gamma RI, Fc Gamma RII, Fc Gamma RIII, and FcRn and design of IgG1 Variants with Improved Binding to the Fc Gamma R. Journal of Biological Chemistry 276(9):6591-6604 (2001).
Shore, David A. et al. Chapter 12: Glycosylation and the function of the T cell co-receptor CD8. Advances in experimental medicine and biology 564:71-84 (2005).
Sidhu, Sachdev S. et al. Phage-displayed Antibody Libraries of Synthetic Heavy Chain Complementarity Determining Regions. Journal of Molecular Biology 338(2):299-310 (2004).
Sim, Gek Kee. et al. Primary Structure Of Human T-Cell Receptor Alpha-chain. Nature 312(5996):771-775 (1984).
Sims, Martin J. et al. A Humanized CD18 Antibody Can Block Function Without Cell Destruction. Journal of Immunology 151(4):2296-2308 (1993).
Smith, et al. T cell inactivation and cytokine deviation promoted by anti-CD3 mAbs. Curr Opin Immunol 9(5):648-54 (1997).
Smith, Temple F, and Michael S. Waterman. Comparison of Biosequences. Advances in Applied Mathematics 2(4):482-489 (1981).
Song, De-Gang. et al. CD27 Costimulation Augments the Survival and Antitumor Activity of Redirected Human T cells in vivo. Blood 119(3):696-706 (2012).
Srivastava, Shivani, and Stanley R Riddell. Engineering CAR-T cells: Design concepts. Trends in immunology 36(8):494-502 (2015).
Staerz, Uwe D, and Michael J. Bevan. Activation of resting T lymphocytes by a monoclonal antibody directed against an allotypic determinant on the T cell receptor. Eur. J. Immunol 16:263-270 (1986).
Stegelmann, F. et al. DNMT3a Mutations in Myeloproliferative Neoplasms. Leukemia 25(7):1217-1219 (2011).
Stein, et al. Disruption of the ASXL1 gene is frequent in primary, post-essential thrombocytosis and post-polycythemia vera myelofibrosis,

(56) References Cited

OTHER PUBLICATIONS but not essential thrombocytosis or polycythemia vera: analysis of molecular genetics and clinical phenotypes. Haematologica 96(10):1462-9 (2011).
Stein, et al. Natural Killer (NK)- and T-Cell Engaging Antibody-Derived Therapeutics. Antibodies 1(1):88-123 (2012).
Stein, Sokrates. et al. Protective Roles of SIRT1 in Atherosclerosis. Cell Cycle 10(4):640-647 (2011).
Streltsov, Victor A. et al. Structure of a Shark IgNAR Antibody Variable Domain and Modeling of an Early-developmental Isotype. Protein Science 14(11):2901-2909 (2005).
Surman, Sherri L. et al. Clonally Related CD8+ T Cells Responsible for Rapid Population of Both Diffuse Nasal-associated Lymphoid Tissue and Lung After Respiratory Virus Infection. Journal of Immunology 187(2):835-841 (2011).
Suzuki-Inoue, et al. Involvement of the Snake Toxin Receptor CLEC-2, in Podoplanin-mediated Platelet Activation, by Cancer Cells. The Journal of Biological Chemistry, 282(36):25993-26001 (2007).
Sze, Daniel M. et al. Clonal cytotoxic T cells are expanded in myeloma and reside in the CD8(+)CD57(+)CD28(−) compartment. Blood 98(9):2817-2827 (2001).
Szeto, Christopher. et al. Molecular Basis of a Dominant SARS-COV-2 Spike-Derived Epitope Presented by HLA-A*02:01 Recognised by a Public TCR. Cells 10(10):2646, 1-15 (2021).
Tan, Huo. et al. Clonal expanded TRA and TRB subfamily T cells in peripheral blood from patients with diffuse large B-cell lymphoma. Hematology 15(2):81-87 (2010).
Tang, Yong. et al. Regulation of Antibody-dependent Cellular Cytotoxicity by IgG Intrinsic and Apparent Affinity for Target Antigen. Journal of Immunology 179(5):2815-2823 (2007).
Tastan, Cihan. et al. Tuning of human MAIT cell activation by commensal bacteria species and MR1-dependent T-cell presentation. Mucosal Immunol 11(6):1591-1605 (2018).
Torgov, Michael Y. et al. Generation of an Intensely Potent Anthracycline by a Monoclonal Antibody-beta-galactosidase Conjugate. Bioconjugate Chemistry 16(3):717-721 (2005).
Traunecker, André. et al. Bispecific Single Chain Molecules (Janusins) Target Cytotoxic Lymphocytes on HIV Infected Cells. The EMBO Journal 10(12):3655-3659 (1991).
Tutt, Alison. et al. Trispecific F(ab')3 Derivatives that Use Cooperative Signaling via the TCR/CD3 Complex and CD2 to Activate and Redirect Resting Cytotoxic T cells. Journal of Immunology 147(1):60-69 (1991).
Tutt, Alison L. et al. Activation and preferential expansion of rat cytotoxic (CD8) T cells in vitro and in vivo with a bispecific (anti-TCR alpha/beta x anti-CD2) F(ab')2 antibody. Journal of immunology 155(6):2960-2971 (1995).
Umezawa, F, and Y Eto. Liposome Targeting to Mouse Brain: Mannose as a Recognition Marker. Biochemical and Biophysical Research Communications 153(3):1038-1044 (1988).
UniProt reference No. P04626. Receptor Tyrosine-Protein Kinase erbB-2. Record created Nov. 1, 1988. pp. 1-19. Retrieved Sep. 27, 2024 at URL: https://www.uniprot.org/uniprotkb/P04626/entry.
UniProt reference No. Q9HBE4. Interleukin-21. Record created Mar. 1, 2001. pp. 1-9. Retrieved Sep. 27, 2024 at URL: https://www.uniprot.org/uniprotkb/Q9HBE4/entry.
UniProtKB Accession No. A0A075B6N4. T cell receptor beta variable 25-1. Record created Oct. 1, 2014. pp. 1-9. Retrieved Sep. 9, 2024 at URL: https://www.uniprot.org/uniprotkb/A0A075B6N4/entry.
UniProtKB Accession No. A0AOB4J240. T cell receptor alpha variable 10. Record created Mar. 11, 2015. pp. 1-9. Retrieved Sep. 9, 2024 at URL: https://www.uniprot.org/uniprotkb/A0A0B4J240/entry.
UniProtKB Accession No. A0A1G7UTW6_9SPHI. Uncharacterized protein Pedobacter terrae (Nov. 22, 2017). Retrieved Jul. 16, 2024 at URL: https://rest.uniprot.org/unisave/A0A1G7UTW6?format=txt&versions=1. One page.
UniProtKB Accession No. A0A2V7GPM2_9BACT. Uncharacterized protein Gemmatimonadetes bacterium (Sep. 12, 2018). Retrieved Jul. 16, 2024 at URL: https://rest.uniprot.org/unisave/A0A2V7GPM2?format=txt&versions=1. One page.
UniProtKB Accession No. A0A4R2QB30. Uncharacterized protein. Record created Jul. 31, 2019. pp. 1-5. Retrieved Jun. 6, 2025. Available at URL: https://www.uniprot.org/uniprotkb/A0A4R2QB30/entry.
UniProtKB Accession No. 000220. Tumor necrosis factor receptor superfamily member 10A. Record created Jul. 1, 1997. Retrieved Aug. 16, 2024 at URL: https://www.uniprot.org/uniprotkb/O00220/entry pp. 1-9.
UniProtKB Accession No. 014763. Tumor necrosis factor receptor superfamily member 10B. Record created Jan. 1, 1998. Retrieved Aug. 16, 2024 at URL: https://www.uniprot.org/uniprotkb/014763/entry pp. 1-10.
UniProtKB Accession No. 014931. Natural cytotoxicity triggering receptor 3. Record created Jan. 1, 1998. Retrieved Nov. 14, 2024 at URL: https://www.uniprot.org/uniprotkb/014931/entry pp. 1-10.
UniProtKB Accession No. 095760. Interleukin-33. Record created May 1, 1999. pp. 1-10. Retrieved Sep. 9, 2024 at URL: https://www.uniprot.org/uniprotkb/095760/entry.
UniProtKB Accession No. 095866. Megakaryocyte and platelet inhibitory receptor G6b. Record created May 1, 1999. Retrieved Aug. 16, 2024 at URL: https://www.uniprot.org/uniprotkb/095866/entry pp. 1-11.
UniProtKB Accession No. P01137. Transforming growth factor beta-1 proprotein. Record created Nov. 1, 1988. Retrieved Aug. 16, 2024 at URL: https://www.uniprot.org/uniprotkb/P01137/entry pp. 1-17.
UniProtKB Accession No. P01562. Interferon alpha-1/13. Record created Nov. 1, 1988. pp. 1-10. Retrieved Sep. 9, 2024 at URL: https://www.uniprot.org/uniprotkb/P01562/entry.
UniProtKB Accession No. P01563. Interferon alpha-2. Record created Nov. 1, 1988. pp. 1-12. Retrieved Oct. 9, 2024 at URL: https://www.uniprot.org/uniprotkb/P01563/entry.
UniProtKB Accession No. P01566. Interferon alpha-10. Record created Nov. 1, 1988. pp. 1-10. Retrieved Sep. 9, 2024 at URL: https://www.uniprot.org/uniprotkb/P01566/entry.
UniProtKB Accession No. P01567. Interferon alpha-7. Record created Nov. 1, 1988. pp. 1-7. Retrieved Sep. 9, 2024 at URL: https://www.uniprot.org/uniprotkb/P01567/entry.
UniProtKB Accession No. P01568. IFN21_HUMAN. Record created Nov. 1, 1988. pp. 1-7. Retrieved Sep. 9, 2024 at URL: https://www.uniprot.org/uniprotkb/P01568/entry.
UniProtKB Accession No. P01569. Interferon alpha-5. Record created Nov. 1, 1988. pp. 1-10. Retrieved Sep. 9, 2024 at URL: https://www.uniprot.org/uniprotkb/P01569/entry.
UniProtKB Accession No. P01570. IFN14_HUMAN. Record created Nov. 1, 1988. pp. 1-7. Retrieved Sep. 9, 2024 at URL: https://www.uniprot.org/uniprotkb/P01570/entry.
UniProtKB Accession No. P01574. Interferon beta. Record created Nov. 1, 1988. pp. 1-9. Retrieved Sep. 9, 2024 at URL: https://www.uniprot.org/uniprotkb/P01574/entry.
UniProtKB Accession No. P01854. Immunoglobulin heavy constant epsilon. Record created Nov. 1, 1988. Retrieved Nov. 15, 2024 at URL: https://www.uniprot.org/uniprotkb/P01854/entry pp. 1-10.
UniProtKB Accession No. P01859. Immunoglobulin heavy constant gamma 2. Record created Nov. 1, 1988. pp. 1-9. Retrieved Oct. 11, 2024 at URL: https://www.uniprot.org/uniprotkb/P01859/entry.
UniProtKB Accession No. P01860. Immunoglobulin heavy constant gamma 3. Record created Nov. 1, 1988. pp. 1-14. Retrieved Oct. 11, 2024 at URL: https://www.uniprot.org/uniprotkb/P01860/entry.
UniProtKB Accession No. P01861. Immunoglobulin heavy constant gamma 4. Record created Nov. 1, 1988. pp. 1-13. Retrieved Oct. 11, 2024 at URL: https://www.uniprot.org/uniprotkb/P01861/entry.
UniProtKB Accession No. P01871. Immunoglobulin heavy constant mu. Record created Nov. 1, 1988. Retrieved Nov. 15, 2024 at URL: https://www.uniprot.org/uniprotkb/P01871/entry pp. 1-12.

(56) References Cited

OTHER PUBLICATIONS

UniProtKB Accession No. P01876. Immunoglobulin heavy constant alpha 1. Record created Nov. 1, 1988. Retrieved Nov. 15, 2024 at URL: https://www.uniprot.org/uniprotkb/P01876/entry pp. 1-9.
UniProtKB Accession No. P01877. Immunoglobulin heavy constant alpha 2. Record created Nov. 1, 1988. Retrieved Nov. 15, 2024 at URL: https://www.uniprot.org/uniprotkb/P01877/entry pp. 1-9.
UniProtKB Accession No. P05013. Interferon alpha-6. Record created Nov. 1, 1988. pp. 1-11. Retrieved Sep. 9, 2024 at URL: https://www.uniprot.org/uniprotkb/P05013/entry.
UniProtKB Accession No. P05014. Interferon alpha-4. Record created Nov. 1, 1988. pp. 1-11. Retrieved Sep. 9, 2024 at URL: https://www.uniprot.org/uniprotkb/P05014/entry.
UniProtKB Accession No. P05106. Integrin beta-3. Record created Nov. 1, 1988. Retrieved Aug. 16, 2024 at URL: https://www.uniprot.org/uniprotkb/P05106/entry pp. 1-20.
UniProtKB Accession No. P05107. Integrin beta-2. Record created Nov. 1, 1988. Retrieved Aug. 16, 2024 at URL: https://www.uniprot.org/uniprotkb/P05107/entry pp. 1-15.
UniProtKB Accession No. P07359. Platelet glycoprotein Ib alpha chain. Record created Nov. 1, 1988. Retrieved Aug. 16, 2024 at URL: https://www.uniprot.org/uniprotkb/P07359/entry pp. 1-15.
UniProtKB Accession No. P08514. Integrin alpha-IIb. Record created Nov. 1, 1988. Retrieved Aug. 16, 2024 at URL: https://www.uniprot.org/uniprotkb/P08514/entry pp. 1-15.
UniProtKB Accession No. PODOX5. Immunoglobulin gamma-1 heavy chain. Record created Mar. 15, 2017. Retrieved Nov. 6, 2024 at URL: https://www.uniprot.org/uniprotkb/PODOX5/entry pp. 1-4.
UniProtKB Accession No. P10600. Transforming growth factor beta-3 proprotein. Record created Jul. 1, 1989. Retrieved Aug. 16, 2024 at URL: https://www.uniprot.org/uniprotkb/P10600/entry pp. 1-11.
UniProtKB Accession No. P10721. Mast/stem cell growth factor receptor Kit. Record created Jul. 1, 1989. Retrieved Aug. 16, 2024 at URL: https://www.uniprot.org/uniprotkb/P10721/entry pp. 1-20.
UniProtKB Accession No. P12318. Low affinity immunoglobulin gamma Fc region receptor II-a. Record created Oct. 1, 1989. Retrieved Aug. 16, 2024 at URL: https://www.uniprot.org/uniprotkb/P12318/entry pp. 1-9.
UniProtKB Accession No. P16109. P-selectin. Record created Apr. 1, 1990. Retrieved Aug. 16, 2024 at URL: https://www.uniprot.org/uniprotkb/P16109/entry pp. 1-12.
UniProtKB Accession No. P28906. Hematopoietic progenitor cell antigen CD34. Record created Dec. 1, 1992. Retrieved Aug. 16, 2024 at URL: https://www.uniprot.org/uniprotkb/P28906/entry pp. 1-10.
UniProtKB Accession No. P29459. Interleukin-12 subunit alpha. Record created Apr. 1, 1993. pp. 1-13. Retrieved Sep. 9, 2024 at URL: https://www.uniprot.org/uniprotkb/P29459/entry.
UniProtKB Accession No. P29460. Interleukin-12 subunit beta. Record created Apr. 1, 1993. pp. 1-10. Retrieved Sep. 9, 2024 at URL: https://www.uniprot.org/uniprotkb/P29460/entry.
UniProtKB Accession No. P30408. Transmembrane 4 L6 family member 1. Record created Apr. 1, 1993. Retrieved Aug. 16, 2024 at URL: https://www.uniprot.org/uniprotkb/P30408/entry pp. 1-7.
UniProtKB Accession No. P32881. Interferon alpha-8. Record created Oct. 1, 1993. pp. 1-7. Retrieved Sep. 9, 2024 at URL: https://www.uniprot.org/uniprotkb/P32881/entry.
UniProtKB Accession No. P36888. Receptor-type tyrosine-protein kinase FLT3. Record created Jun. 1, 1994. Retrieved Aug. 16, 2024 at URL: https://www.uniprot.org/uniprotkb/P36888/entry pp. 1-13.
UniProtKB Accession No. P36897. TGF-beta receptor type-1. Record created Jun. 1, 1994. Retrieved Aug. 16, 2024 at URL: https://www.uniprot.org/uniprotkb/P36897/entry pp. 1-16.
UniProtKB Accession No. P37173. TGF-beta receptor type-2. Record created Oct. 1, 1994. Retrieved Aug. 16, 2024 at URL: https://www.uniprot.org/uniprotkb/P37173/entry pp. 1-18.
UniProtKB Accession No. P40238. Thrombopoietin receptor. Record created Feb. 1, 1995. Retrieved Aug. 16, 2024 at URL: https://www.uniprot.org/uniprotkb/P40238/entry pp. 1-11.
UniProtKB Accession No. P40933. Interleukin-15. Record created Feb. 1, 1995. pp. 1-9. Retrieved Sep. 9, 2024 at URL: https://www.uniprot.org/uniprotkb/P40933/entry.
UniProtKB Accession No. P55285. Cadherin-6. Record created Oct. 1, 1996. Retrieved Jun. 17, 2025 at URL: https://www.uniprot.org/uniprotkb/P55285/entry pp. 1-26.
UniProtKB Accession No. P56856. Cld_Human. 14 pages. Retrieved Oct. 7, 2024 at URL: https://www.uniprot.org/uniprotkb/P56856/entry.
UniProtKB Accession No. P60568. Interleukin-2. Record created Mar. 15, 2004. pp. 1-12. Retrieved Jul. 12, 2024 at URL: https://www.uniprot.org/uniprotkb/P60568/entry.
UniProtKB Accession No. P61812. Transforming growth factor beta-2 proprotein. Record created Jun. 7, 2004. Retrieved Aug. 16, 2024 at URL: https://www.uniprot.org/uniprotkb/P61812/entry pp. 1-12.
UniProtKB Accession No. Q02487. Desmocollin-2. Record created Feb. 1, 1994. Retrieved Aug. 16, 2024 at URL: https://www.uniprot.org/uniprotkb/Q02487/entry pp. 1-15.
UniProtKB Accession No. Q03167. Transforming growth factor beta receptor type 3. Record created Feb. 1, 1994. Retrieved Aug. 16, 2024 at URL: https://www.uniprot.org/uniprotkb/Q03167/entry pp. 1-10.
UniProtKB Accession No. Q14116. Interleukin-18. Record created Nov. 1, 1996. pp. 1-10. Retrieved Sep. 9, 2024 at URL: https://www.uniprot.org/uniprotkb/Q14116/entry.
UniProtKB Accession No. Q685J3. MUC17_HUMAN. Record created Oct. 11, 2004. Retrieved Apr. 24, 2025. Available at URL: https://www.uniprot.org/uniprotkb/Q685J3/entry pp. 1-8.
UniProtKB Accession No. Q96NY8. Nectin-4. Record created Dec. 1, 2001. pp. 1-10. Retrieved Apr. 23, 2025. Available at URL: https://www.uniprot.org/uniprotkb/Q96NY8/entry.
UniProtKB Accession No. Q9H293. Interleukin-25. Record created Mar. 1, 2001. pp. 1-7. Retrieved Sep. 9, 2024 at URL: https://www.uniprot.org/uniprotkb/Q9H293/entry.
UniProtKB Accession No. Q9NPF7. Interleukin-23 subunit alpha. Record created Oct. 1, 2000. pp. 1-13. Retrieved Sep. 9, 2024 at URL: https://www.uniprot.org/uniprotkb/Q9NPF7/entry.
UniProtKB Accession No. Q9NYJ7. Delta-like protein 3. Record created Oct. 1, 2000. pp. 1-9. Retrieved Oct. 10, 2024 at URL: https://www.uniprot.org/uniprotkb/Q9NYJ7/entry.
Urakami, Akane. et al. An Envelope-Modified Tetravalent Dengue Virus-Like-Particle Vaccine Has Implications for Flavivirus Vaccine Design. Journal of virology 91(23):e00090-17, 1-16 (2017).
U.S. Appl. No. 15/465,564 Notice of Allowance dated Nov. 10, 2021.
U.S. Appl. No. 15/465,564 Notice of Allowance dated Oct. 29, 2021.
U.S. Appl. No. 15/465,564 Office Action dated Apr. 29, 2020.
U.S. Appl. No. 15/465,564 Office Action dated May 26, 2021.
U.S. Appl. No. 15/465,564 Office Action dated Oct. 13, 2020.
U.S. Appl. No. 15/465,564 Office Action dated Sep. 9, 2019.
U.S. Appl. No. 16/960,704 Corrected Notice of Allowability dated Dec. 20, 2024.
U.S. Appl. No. 16/960,704 Notice of Allowance dated Dec. 19, 2024.
U.S. Appl. No. 16/960,704 Office Action dated Dec. 22, 2023.
U.S. Appl. No. 16/960,704 Office Action dated Jul. 5, 2024.
U.S. Appl. No. 16/980,730 Notice of Allowance dated Jun. 13, 2024.
U.S. Appl. No. 16/980,730 Office Action dated Feb. 12, 2024.
U.S. Appl. No. 16/980,771 Office Action dated Jan. 10, 2024.
U.S. Appl. No. 17/256,917 Notice of Allowance dated Sep. 7, 2023.
U.S. Appl. No. 17/366,638 Office Action dated Apr. 17, 2025.
U.S. Appl. No. 17/366,638 Office Action dated Apr. 25, 2024.
U.S. Appl. No. 17/366,638 Office Action dated Aug. 27, 2024.
U.S. Appl. No. 17/402,318 Office Action dated Mar. 19, 2025.
U.S. Appl. No. 17/402,320 Notice of Allowance dated Apr. 15, 2025.
U.S. Appl. No. 17/402,320 Office Action dated Dec. 12, 2024.
U.S. Appl. No. 17/402,322 Office Action dated Jul. 14, 2025.
U.S. Appl. No. 17/402,322 Office Action dated Nov. 19, 2024.

(56) References Cited

OTHER PUBLICATIONS

U.S. Appl. No. 17/402,325 Notice of Allowance dated Apr. 14, 2025.
U.S. Appl. No. 17/402,325 Office Action dated Sep. 24, 2024.
U.S. Appl. No. 17/402,329 Office Action dated May 8, 2025.
U.S. Appl. No. 17/402,329 Office Action dated Nov. 5, 2024.
U.S. Appl. No. 17/529,017 Office Action dated Nov. 18, 2022.
U.S. Appl. No. 17/584,892 Office Action dated Feb. 3, 2025.
U.S. Appl. No. 17/584,892 Office Action dated Jul. 9, 2025.
U.S. Appl. No. 17/584,892 Office Action dated Sep. 17, 2025.
U.S. Appl. No. 17/820,634 Office Action dated Apr. 19, 2023.
U.S. Appl. No. 17/820,634 Office Action dated Aug. 11, 2023.
U.S. Appl. No. 17/820,634 Office Action dated Aug. 15, 2023.
U.S. Appl. No. 17/820,794 Notice of Allowance dated Feb. 1, 2024.
U.S. Appl. No. 17/820,794 Office Action dated Dec. 29, 2023.
U.S. Appl. No. 17/820,794 Office Action dated Mar. 31, 2023.
U.S. Appl. No. 17/820,794 Office Action dated Sep. 15, 2023.
U.S. Appl. No. 17/820,800 Office Action dated Feb. 21, 2023.
U.S. Appl. No. 17/820,800 Office Action dated Jun. 1, 2023.
U.S. Appl. No. 17/820,805 Notice of Allowance dated Jan. 24, 2025.
U.S. Appl. No. 17/820,805 Office Action dated Apr. 26, 2024.
U.S. Appl. No. 17/820,805 Office Action dated Aug. 14, 2023.
U.S. Appl. No. 17/820,805 Office Action dated Oct. 31, 2024.
U.S. Appl. No. 17/820,806 Office Action dated Apr. 12, 2023.
U.S. Appl. No. 17/820,806 Office Action dated Aug. 15, 2023.
U.S. Appl. No. 17/820,811 Office Action dated May 25, 2023.
U.S. Appl. No. 17/820,818 Office Action dated Jun. 1, 2023.
U.S. Appl. No. 17/820,818 Office Action dated Mar. 12, 2024.
U.S. Appl. No. 17/855,332 Office Action dated Jun. 18, 2025.
U.S. Appl. No. 17/932,416 Office Action dated May 29, 2025.
U.S. Appl. No. 18/341,688 Office Action dated Aug. 5, 2025.
U.S. Appl. No. 18/341,688 Office Action dated Jan. 25, 2024.
U.S. Appl. No. 18/341,688 Office Action dated Mar. 5, 2025.
U.S. Appl. No. 18/341,688 Office Action dated May 10, 2024.
U.S. Appl. No. 18/472,920 Notice of Allowance dated Apr. 9, 2025.
U.S. Appl. No. 18/472,920 Office Action dated Nov. 4, 2024.
Valkenburg, Sophie A. et al. Molecular Basis for Universal HLA-A*0201-restricted CD8+ T-cell Immunity Against Influenza Viruses. Proceedings of the National Academy of Sciences of the United States of America 113(16):4440-4445 (2016).
Van Dijk, Marc A. et al. Human Antibodies as Next Generation Therapeutics. Current Opinion in Chemical Biology 5(4):368-374 (2001).
Van Mierlo, Carlo PM, and Elles Steensma. Protein Folding and Stability Investigated by Fluorescence, Circular Dichroism (CD), and Nuclear Magnetic Resonance (NMR) Spectroscopy: the Flavodoxin Story. Journal of Biotechnology 79(3):281-298 (2000).
Van Rhijn, I. et al., "A conserved human T cell population targets mycobacterial antigens presented by CD1b," Nat Immunol., 2013;14(7):706-713.
Van Rhijn, I. et al., "TCR bias and affinity define two compartments of the CD1b-glycolipid-specific T Cell repertoire," J Immunol., 2014;192(9):4054-4060.
Vantourout, Pierre. et al. Innate TCRβ-chain engagement drives human T cells toward distinct memory-like effector phenotypes with immunotherapeutic potentials. Science Advances 9(49):eadj6174, 1-19 (2023).
Viney, Joanne L. et al. Generation of Monoclonal Antibodies Against a Human T Cell Receptor Beta Chain Expressed in Transgenic Mice. Hybridoma 11(6):701-713 (1992).
Vitetta, Ellen S. et al. Redesigning Nature's Poisons to Create Anti-tumor Reagents. Science 238(4830):1098-1104 (1987).
Vollmers, H P. et al. Death by Stress: Natural IgM-induced Apoptosis. Methods and Findings in Experimental and Clinical Pharmacology 27(3):185-191 (2005).
Vollmers, H P. et al. The "Early Birds": Natural IgM Antibodies and Immune Surveillance. Histology and Histopathology 20(3):927-937 (2005).
Walker, Laura M. et al. Broad and Potent Neutralizing Antibodies from an African Donor Reveal a New HIV-1 Vaccine Target. Science 326(5950):285-289 (2009).
Walker, Laura M. et al. Broad Neutralization Coverage of Hiv by Multiple Highly Potent Antibodies. Nature 477(7365):466-470 (2011).
Wang, Zhenguang. et al. Current status and perspectives of chimeric antigen receptor modified T cells for cancer treatment. Protein and Cell 8(12):896-925 (2017).
Ward, E Sally et al. Binding Activities of a Repertoire of Single Immunoglobulin Variable Domains Secreted from *Escherichia coli*. Nature 341(6242):544-546 (1989).
Watanabe, M. et al. Interleukin-21 Can Efficiently Restore Impaired Antibody-dependent Cell-mediated Cytotoxicity in Patients With Oesophageal Squamous Cell Carcinoma. British Journal of Cancer 102(3):520-529 (2010).
Watson, C.T. et al. Revisiting the T-cell receptor alpha/delta locus and possible associations with multiple sclerosis. Genes and immunity 12(2):59-66 (2011).
Weisser, Nina E, and J Christopher Hall. Applications of single-chain variable fragment antibodies in therapeutics and diagnostics. Biotechnology advances 27(4):502-520 (2009).
Willemsen, R A. et al. Grafting Primary Human T Lymphocytes With Cancer-specific Chimeric Single Chain and Two Chain TCR. Gene Therapy 7(16):1369-1377 (2000).
Winkler, Karsten. et al. Changing the antigen binding specificity by single point mutations of an anti-p24 (HIV-1) antibody. The Journal of Immunology 165(8):4505-4514 (2000).
Winter, Greg. et al. Making Antibodies by Phage Display Technology. Annual Review of Immunology 12(1):433-455 (1994).
Wright, Ann, and Sherie L. Morrison et al. Effect of Glycosylation on Antibody Function: Implications for Genetic Engineering TIBTECH 15(1):26-32 (1997).
Wu, Zhihua. et al. T cell receptor beta-chain CDR3 spectratyping and cytomegalovirus activation in allogeneic hematopoietic stem cell transplant recipients. Journal of Zhejiang University Medical Sciences 45(5):515-521 (2016). With English abstract.
Wucherpfennig, Kai W. et al. T cell receptor V alpha-V beta repertoire and cytokine gene expression in active multiple sclerosis lesions. The Journal of experimental medicine 175(4):993-1002 (1992).
Xiang, Jianhua H. et al. Modification in Framework Region I Results in a Decreased Affinity of Chimeric Anti-TAG72 antibody. Molecular Immunology 28(1-2):141-148 (1991).
Xu, Jian. et al. MIR548P and TRAV39 Are Potential Indicators of Tumor Microenvironment and Novel Prognostic Biomarkers of Esophageal Squamous Cell Carcinoma. Journal of Clinical Oncology 2022:3152114, 1-20 (2022).
Yamane-Ohnuki, Naoko et al. Establishment of FUT8 Knockout Chinese Hamster Ovary Cells: an Ideal Host Cell Line for Producing Completely Defucosylated Antibodies With Enhanced Antibody-dependent Cellular Cytotoxicity. Biotechnology and Bioengineering 87(5):614-622 (2004).
Yang, Xinbo. et al. Structural basis for clonal diversity of the human T-cell response to a dominant influenza virus epitope. J Biol Chem 292(45):18618-18627 (2017).
Yazaki, Paul J, and Anna M Wu. Expression of Recombinant Antibodies in Mammalian Cell Lines. Methods in Molecular Biology 248:255-268 (2004).
Yohannes, Dawit A. et al. Deep Sequencing of Blood and Gut T-cell Receptor B-chains Reveals Gluten-induced Immune Signatures in Celiac Disease. Scientific Reports 7(1):17977, 1-12 (2017).
Zhang, Tong. et al. An NKp30-Based Chimeric Antigen Receptor Promotes T cell Effector Functions and Antitumor Efficacy In Vivo. Journal of Immunology 189(5):2290-2299 (2012).
Zhang, Tong. et al. Transgenic TCR Expression: Comparison of Single Chain With Full-length Receptor Constructs for T-cell Function. Cancer Gene Therapy 11(7):487-496 (2004).
Zhou, Hongyu. et al. A Novel Risk Score System of Immune Genes Associated With Prognosis in Endometrial Cancer. Cancer Cell International 20:240, 1-12 (2020).
Zitti, et al. Natural killer cells in inflammation and autoimmunity. Cytokine & Growth Factor Reviews 42:37-46 (2018).

(56) References Cited

OTHER PUBLICATIONS

Adachi, O. et al., "Targeted Disruption of the MyD88 Gene Results in Loss of IL-1-and IL-8-Mediated Function", Immunity, 1998, vol. 9, pp. 143-150.
Agostinis, P. et al., "Photodynamic Therapy of Cancer: an Update", CA Cancer J. Clin, 2011, vol. 61, No. 4, pp. 250-281.
Aigner et al.: An effective tumor vaccine optimized for costimulation via bispecific and trispecific fusion proteins. Int J Oncol. 32(4):777-789 (2008).
Akiyama et al.: TNFalpha induces rapid activation and nuclear translocation of telomerase in human lymphocytes. Biochem Biophys Res Commun. 316(2):528-532 (2004).
"Ala-Aho, R. et al., "Collagenases in cancer", Biochimie, 2005, vol. 87, pp. 273-286".
Ali et al.: Modulation of human natural killer cytotoxicity by influenza virus and its subunit protein. Immunology 52(4):687-695 (1984).
Al-Lazikani, B. et al, "Standard Conformations for Canonical Structures of Immunoglobulins", J. Mol. Biol., 1997, vol. 273 , pp. 927-948.
Altschul, S. et al, "Basic Local Alignment Search Tool", J. Mol Biol., 1990, vol. 215, pp. 403-410.
Altschul, S. et al., "Gapped BLAST and PSI-BLAST: a new generation of protein database search programs", Nucleic Acids Research, 1997, vol. 25, No. 17, pp. 3389-3402.
Amarante-Mendes GP, Griffith TS. Therapeutic applications of TRAIL receptor agonists in cancer and beyond. Pharmacol Ther. Nov. 2015;155:117-31. Epub Sep. 5, 2015.
Arai, R. et al., "Design of the linkers which effectively separate domains of a bifunctional fusion protein", Protein Engineering, 2001, vol. 14, No. 8, pp. 529-532.
Arenas-Ramirez et al.: Interleukin-2: Biology, Design and Application. Trends in Immunology 36(12):763-777 (2015).
Arnon, T.I. et al., "Recognition of viral hemagglutinins by NKp44 but not by NKp30", Eur J. Immunol., 2001, vol. 31, No. 9, pp. 2680-2689.
Aslan, J.E. et al., "S6K1 and mTOR regulate Rac1-driven platelet activation and aggregation", Blood, 2011, vol. 118, No. 11, pp. 3129-3136.
"Sastry, K., et al., "Targeting hepatitis B virus-infected cells with a T-cell receptor-like antibody," J. Virol., 2011, vol. 85, No. 5, pp. 1935-1942".
"Aversa, et al., "Molecular T-Cell Repertoire Analysis as Source of Prognostic and Predictive biomarkers for Checkpoint blockade Immunotherapy" International Journal of Molecular Sciences (2020), 21, 2378, p. 1-19".
Banerjee, et al., "33rd annual Meeting & Pre-Conference Programs of the Society for Immunotherapy of Cancer (SITC) 2018 p. 1-192".
Barbas, C.F. et al., "Assembly of combinatorial antibody libraries on phage surfaces: The gene III site", PNAS, 1991, vol. 88, pp. 7978-7982.
Beidler, C.B. et al., "Cloning and high level expression of a chimeric antibody with specificity for human carcinoembryonic antigen", J. Immuno, 1988, vol. 141, pp. 4053-4060.
"Berge, et al., "Selective expansion of a peripheral blood CD8+ memory T cell subset expressing both granzyme B and I-selectin during primary viral infection in renal allograft recipients", Transplantation Proceedings, 1998, vol. 30, pp. 3975-3977".
Better, M. et al., "*Escherichia coli* Secretion of an Active Chimeric Antibody Fragment", Science, 1988, vol. 240, No. 4855, pp. 1041-1043.
Beun, G. et al., "T cell Retargeting Using Bispecific Monoclonal Antibodies in a Rat Colon Carcinoma Model", The Journal of Immunology, 1993, vol. 150, No. 6, pp. 2305-2315.
"Bierer, B. et al., "Cyclosporin A and FK506: molecular mechanisms of immunosuppression and probes for transplantation biology", Curr. Opin. Immun., 1993, vol. 5, No. 5, pp. 763-773".
Bird, R. et al., "Single-Chain Antigen-Binding Proteins", Science, 1988, vol. 242, No. 4877, pp. 423-426.
Bluemel, C. et al., "Epitope distance to the target cell membrane and antigen size determine the potency of T cell-mediated lysis by BiTE antibodies specific for a large melanoma surface antigen", Cancer Immunology, Immunotherapy, 2010, vol. 59, No. 8, pp. 1197-1209.
Bruggemann, M. et al., Designer Mice: The Production of Human Antibody Repertories in Transgenic Animals, Terhorst C. Malavasi F, Albertini A (eds): Generation of Antibodies by Cell and Gene Immortalization, Year Immunol, 1993, vol. 7, pp. 33-40.
Bruggemann, M. et al., "Human antibody production in transgenic mice: expression from 100kb of the human IgH locus", Eur J. Immunol, 1991, vol. 21, pp. 1323-1326.
Buchwald, H. et al., "Long-term, continuous intravenous heparin administration by an implantable infusion pump in ambulatory patients with recurrent venous thrombosis", Surgery, 1980, vol. 88, No. 4, 507-516.
Cadwell, R. C. et al., "Randomization of Genes by PCR Mutagenesis", PCR Methods Appl., 1992, vol. 2, No. 1, pp. 28-33.
"Cain, C. et al., "Crossing over to bispecificity", SciBX, 2011, vol. 4, pp. 1-3".
Chang et al.: A therapeutic T cell receptor mimic antibody targets tumor-associated PRAME peptide/HLA-I antigens. J Clin Invest. 127(7):2705-2718 (2017).
Chao, G. et al., "Isolating and engineering human antibodies using yeast surface display", Nature Protocols, 2006, vol. 1, No. 2, pp. 755-768.
Chaudry, et al. EpCAM an immunotherapeutic target for gastrointestinal malignancy: current experience and future challenges. Br J Cancer. Apr. 10, 2007;96(7):1013-9. Epub Feb. 27, 2007.
Chen et al.: Chromosome X-encoded cancer/testis antigens show distinctive expression patterns in developing gonads and in testicular seminoma. Hum Reprod. 26(12):3232-3243 doi:10.1093/humrep/der330 (2011).
Chen et al.: The nuclear localization sequences of the BRCA1 protein interact with the importin-alpha subunit of the nuclear transport signal receptor. J Biol Chem. 271(51):32863-32868 (1996).
Chinese Patent Application No. 201780028089.4 2nd Office Action dated Apr. 18, 2022.
"Schmittnaegel, M. et al., "Activation of cytomegalovirus-specific CD8+ T-cell response by antibody-mediated peptide-major histocompatibility class I complexes", OncoImmunology, 2015, vol. 5, No. 1, pp. 1-3".
Chothia, C. et al., "Canonical Structures for the Hypervariable Regions of Immunoglobulins", J. Mol. Biol, 1987, vol. 196, pp. 901-917.
Chothia, C. et al., "Structural repertoire of the human VH segments", J. Mol. Biol., 1992, vol. 227, pp. 799-817.
Clackson, T. et al., Making antibody fragments using phage display libraries, Nature, 1991, vol. 352, pp. 624-628.
Colcher, D. et al., "Single-Chain Antibodies in Pancreatic Cancer", Ann Ny Acad Sci, 1999, vol. 880, pp. 263-280.
Coloma, J. et al., "Design and production of novel tetravalent bispecific antibodies", Nature Biotech, 1997, vol. 15, pp. 159-163.
Costa-Mattioli, M. et al., "RAPping production of type I interferon in pDCs through mTOR", 2008, Nature Immunol, vol. 9, No. 10, pp. 1097-1099.
Cui, et al., "T cell receptor B-chain repertoire analysis of tumor-infiltrating lymphocytes in pancreatic cancer" Cancer Science (2018) 60-71.
"Dao, T. et al., "Targeting the intracellular WT1 oncogene product with a therapeutic human antibody," Sci Transl Med, 2013, vol. 5, No. 176, pp. 1-22".
Davis, J. et al., "SEEDbodies: fusion proteins based on strand-exchange engineered domain (SEED) CH3 heterodimers in an Fc analogue platform for asymmetric binders or immunofusions and bispecific antibodies", Protein Engineering, Design & Selection, 2010, vol. 23, No. 4, pp. 195-202.
Dela Cruz et al.: Anti-HER2/neu IgG3-(IL-2) and anti-HER2/neu IgG3-(GM-CSF) promote HER2/neu processing and presentation by dendritic cells: Implications in immunotherapy and vaccination strategies. Molecular immunology 43(6):667-676 (2006).

(56) References Cited

OTHER PUBLICATIONS

Dickopf, S. et a., "Formal and geometries matter: Structure-based design defines the functionality of bispecific antibodies", Computational and Structural Biotechnology Journal, 2020, vol. 18, pp. 1221-1227.
Dimasi et al. Development of a trispecific antibody designed to simultaneously and efficiently target three different antigens on tumor cells. Mol Pharm 12(9):3490-3501 (2015).
"Doyle, S. et al., "IRF3 Mediates a TLR3/TLR4-Specific Antiviral Gene Program", Immunity, 2002, vol. 17, pp. 251-263".
"Duhen, et al., "Co-expression of CD39 and CD103 identifies tumor-reactive CD8 T cells in human solid tumors" Nature Communications (2018) 9:2724, p. 1-13".
"During, M. J. et al., "Controlled release of dopamine from a polymeric brain implant: in vivo characterization", American Neurological Association, 1989, vol. 25, pp. 351-356".
"Sefton, Michael V., "Implantable Pumps", CRC Crit. Ref. Biomed. Eng., 1987, vol. 14, No. 3, pp. 201-240".
"Sergeeva, A. et al., "An anti-PR1/HLA-A2 T-cell receptor-like antibody mediates complement-dependent cytotoxicity against acute myeloid leukemia progenitor cells," Blood, 2011, vol. 117, No. 16, pp. 4262-4272".
European Patent Application No. 17 718 441.3 Office Action dated Jan. 24, 2022.
European Search Report issued in EP20736073, dated Aug. 2, 2022.
Falini et al.: Cytoplasmic nucleophosmin in acute myelogenous leukemia with a normal karyotype. N Engl J Med. 352(3):254-266 doi:10.1056/NEJMoa041974 (2005).
Farrar et al: The Molecular Cell Biology of Interferon-gamma and Its Receptor. Annu Rev Immunol 11:571-611 (1993).
"Fernandez-Malave, et al., "An natural anti-T-cell receptor monoclonal antibody protects against experimental autoimmune encephalomyelitis" Journal of Neuroimmunology 234 (2011) 63-70".
Frost, G. et al., "A Microtiter-Based Assay for Hyaluronidase Activity Not Requiring Specialized Reagents", Analytical Biochemistry, 1997, vol. 251, pp. 263-269.
Fuchs, P. et al., "Targeting Recombinant Antibodies to the surface of *Escherichia coli*: Fusion to the Peptidoglycan associated Lipoprotein", Nature Publishing Group, 1991, vol. 9, No. 12, pp. 1369-1372.
Funayama et al.: Embryonic axis induction by the armadillo repeat domain of beta-catenin: evidence for intracellular signaling. J Cell Biol. 128(5):959-968 (1995).
Gao et al.: Alg14 recruits Alg13 to the cytoplasmic face of the endoplasmic reticulum to form a novel bipartite UDP-N-acetylglucosamine transferase required for the second step of N-linked glycosylation. J Biol Chem. 280(43):36254-36262 doi:10.1074/jbc.M507569200 (2005).
Garland, R.J., et al., "The use of Teflon cell culture bags to expand functionally active CD8+ cytotoxic T lymphocytes", Journal of Immunological Methods, 1999, vol. 227, pp. 53-63.
Garrard, L. et al., "FAB Assembly and Enrichment in a Monovalent Phage Display System", Nature Publishing Group, 1991, vol. 9, pp. 1373-1377.
Garrity, D. et al., "The activating NKG2D receptor assembles in the membrane with two signaling dimers into a hexameric structure", Proc Natl Acad Sci USA, 2005, vol. 102, No. 21, pp. 7641-7646.
GB Exam Report for GB2109794.4 dated Jun. 21, 2020.
Gjerstorff et al.: GAGE cancer-germline antigens are recruited to the nuclear envelope by germ cell-less (GCL). PLoS One 7(9):e45819:1-12 doi:10.1371/journal.pone.0045819 (2012).
Gokden et al.: Diagnostic utility of renal cell carcinoma marker in cytopathology. Appl Immunohistochem Mol Morphol. Abstract Only. 11(2):116-119 doi:10.1097/00129039-200306000-00004 (2003).
Gram, H. et al., In vitro selection and affinity maturation of antibodies from a naïve combinatorial immunoglobulin library, PNAS, 1992, vol. 89, pp. 3576-3580.
"Green, et al., "TCR validation toward gene therapy for cancer" (2019) Methods in Enzymology, vol. 629 chapter 21, p. 419-439".
Green, L.L. et al., "Antigen-specific human monoclonal antibodies from mice engineered with human Ig heavy and light chain YACS", Nature Genet, 1994, vol. 7, pp. 13-21.
Griffiths, A.D. et al., "Human anti-self antibodies with high specificity from phage display libraries", The EMBO Journal, 1993, vol. 12, No. 2, pp. 725-734.
Haanen, J et al., "Selective Expansion of Cross-reactive CD8+ Memory T Cells by Viral Variants", J. Exp. Med., 1999, vol. 190, No. 9, pp. 1319-1328.
"Hall, M. et al., "Expansion of tumor-infiltrating lymphocytes (TIL)from human pancreatic tumors", Journal for Immuno Therapy of Cancer, 2016, vol. 4, pp. 1-12".
Hamid, O. et al., "Safety and Tumor Responses with Lambrolizumab (Anti-PD-1) in Melanoma", The New England Journal of Medicine, 2013, vol. 369, No. 2, pp. 134-144.
Hamming et al.: Crystal Structure of Interleukin-21 Receptor (IL-21R) Bound to IL-21 Reveals That Sugar Chain Interacting with WSXWS Motif Is Integral Part of IL-21R. The Journal of Biological Chemistry 287(12):9454-9460 (2012).
Hawkins, R. et al., "Selection of phage antibodies by binding affinity. Mimicking affinity maturation", J. Mol. Biol., 1992, vol. 226, No. 3, pp. 889-896.
Hay, B. et al., "Bacteriophage cloning and *Escherichia coli* expression of a human IgM Fab" Hum Antibodies Hybridomas, 1992, vol. 3, No. 2, pp. 81-85.
"Henderson, D.J. et al., "Comparison of the effects of FK-506, cyclosporin A and rapamycin on IL-2 production", Immunology, 1991, vol. 73, No. 2, pp. 316-321".
Hershkovitz, O. et al., "NKp44 receptor mediates interaction of the envelope glycoproteins from the West-Nile and dengue viruses with Natural Killer cells," The Journal of Immunology, 2009;183(4):2610-2621.
"Shimabukuro-Vornhagen, A. et al., "Cytokine release syndrome", Journal for Immuno Therapy of Cancer, 2018, vol. 6, No. 56, pp. 1-14".
Hirai et al.: Nucleolar scaffold protein, WDR46, determines the granular compartmental localization of nucleolin and DDX21. Genes Cells 18(9):780-797 (2013).
"Shitaoka, et al., "Identification of Tumoricidal TCRs from Tumor-Infiltrating Lymphocytes by Single-Cell Analysis" (2018) Cancer Immunology Research 6(4), p. 378-389".
"Hiyama, K. et al., "Crystallization and Some Properties of Chondroitinase from Arthrobacter aurescens", The Journal of Biological Chemistry, 1975, vol. 250, No. 5, pp. 1824-1828".
"Hiyama, K. et al., "The mode of Action of Two Chondroitinase-AC Preparations of Different Origin", J. Biochem, 1976, vol. 80, pp. 1201-1207".
"Hollinger, P. et al., "Engineered antibody fragments and the rise of single domains," Nature Biotechnology, 2005, vol. 23, No. 9, pp. 1126-1136".
"Hongyan, et al., "Fc Engineering for Developing Therapeutic Bispecific Antibodies and Novel Scaffolds" Frontiers in Immunology, (2017) vol. 8".
Hoogenboom, H.R. et al, "Multi-subunit proteins on the surface of filamentous phage: methodologies for displaying antibody (Fab) heavy and light chains", Nuc Acid Res, 1991, vol. 19, No. 15, pp. 4133-4137.
"Howard, M.A. et al., "Intracerebral drug delivery in rats with lesion-induced memory deficits", J. Neurosurg, 1989, vol. 71, pp. 105-112".
"Shpilberg, O. et al., "Subcutaneous administration of rituximab (MabThera) and trastuzumab (Herceptin) using hyaluronidase," British Journal of Cancer, 2013, vol. 109, pp. 1556-1561".
Hudspeth et al.: Natural cytotoxicity receptors: broader expression patterns and functions in innate and adaptive immune cells. Frontiers in Immunology 4(69):1-15 (2013).
Hunig, T. et al., "A monoclonal antibody to a constant determinant of the rat t cell antigen receptor that induces t cell activation", J. Exp. Med., 1989, vol. 169, pp. 73-86.
Huse, W. et al., "Generation of a large combinatorial library of the immunoglobulin repertoire in phage lambda" Science, 1989, vol. 246, No. 4935, pp. 1275-1281.

(56) References Cited

OTHER PUBLICATIONS

Huston, J. et al., "Protein engineering of antibody binding sites: Recovery of specific activity in an anti-digoxin single-chain Fv analogue produces in *Escherichia coli*", Proc Natl Acad Sci, 1988, vol. 85, pp. 5879-5883.
International Preliminary Report on Patentability issued in PCT/US2017/023483, dated Sep. 25, 2018.
"International Preliminary Report on Patentability issued in PCT/US2018/029951, dated Oct. 29, 2019.".
International Preliminary Report on Patentability issued in PCT/US2019/040592, dated Jan. 5, 2021.
International Preliminary Report on Patentability issued in PCT/US2020/012162, dated Jun. 16, 2021.
International Preliminary Report on Patentability issued in PCT/US2020/019291, dated Aug. 10, 2021.
International Preliminary Report on Patentability issued in PCT/US2020/019319, dated Aug. 10, 2021.
International Preliminary Report on Patentability issued in PCT/US2020/019321, dated Aug. 10, 2021.
International Preliminary Report on Patentability issued in PCT/US2020/060557 dated May 17, 2022.
International Preliminary Report on Patentability issued in PCT/US/2020/067543, dated Jul. 5, 2022.
International Preliminary Report on Patentability issued in PCT/US2021/022408, dated Sep. 20, 2022.
International Preliminary Report on Patentability issued in PCT/US2021/028970, dated Oct. 25, 2022.
"International Search Report and Written Opinion for corresponding PCT Application No. PCT/US2019/022282 issued Jul. 1, 2019.".
"International Search Report and Written Opinion for corresponding PCT Application No. PCT/US2019/012900 dated 07.05.2019".
International Search Report and Written Opinion issued in PCT/US2017/023483, mailed Aug. 29, 2017.
"International Search Report and Written Opinion issued in PCT/US2018/029951, mailed Mar. 7, 2018.".
International Search Report and Written Opinion issued in PCT/US2019/040592, mailed Jan. 9, 2020.
International Search Report and Written Opinion issued in PCT/US2020/012162 mailed Jun. 26, 2020.
International Search Report and Written Opinion issued in PCT/US2020/019291, mailed Jun. 15, 2020.
International Search Report and Written Opinion issued in PCT/US2020/019319, mailed Jun. 26, 2020.
International Search Report and Written Opinion issued in PCT/US2020/019321, mailed Aug. 10, 2020.
International Search Report and Written Opinion issued in PCT/US2020/060557, mailed Mar. 30, 2021.
International Search Report and Written Opinion issued in PCT/US2020/067543, mailed Jul. 7, 2021.
International Search Report and Written Opinion issued in PCT/US2021/022408, mailed Aug. 31, 2021.
International Search Report and Written Opinion issued in PCT/US2021/028970 mailed Oct. 4, 2021.
International Search Report and Written Opinion issued in PCT/US2021/047571, dated Feb. 14, 2022.
International Search Report and Written Opinion issued in PCT/US2022/023922, mailed Oct. 17, 2022.
"Islam, et al., "changes in the Peripheral blood T-Cell Receptor VB Repertoire In vivo and In Vitro during Shigellosis" Infection and Immunity (1996), Vo. 64, No. 4, p. 1391-1399".
Jameson, Stephen C., "T cell receptor antagonism in vivo, at last", Proc. Natl. Acad. Sci., 1998, vol. 95, pp. 14001-14002.
Jiang et al.: Nuclear expression of CDK4 correlates with disease progression and poor prognosis in human nasopharyngeal carcinoma. Histopathology 64(5):722-730 doi:10.1111/his.12319 (2013).
Jones, P. T. et al., "Replacing the complementarity-determining regions in a human antibody with those from a mouse", Nature, 1986, vol. 321, No. 29, pp. 522-525.
Ju et al.: Structure-function analysis of human interleukin-2. Identification of amino acid residues required for biological activity. The Journal of Biological Chemistry 262(12):5723-5731 (1987).
Kanagawa, et al., "In Vivo T Cell Tumor Therapy With Monoclonal Antibody Directed to the VB chain of T Cell Antigen Receptor" J. Exp. Med., vol. 170, (1989) p. 1513-1519.
"Kanagawa, et al., "The T Cell Receptor VB6 Domain Imparts Reactivity to the Mis-1a Antigen" Cellular Immunology 119, 412-426 (1989)".
Kato et al.: The structure and binding mode of interleukin-18. Nature Structural Biology 10(11):366-971 (2003).
Kato, Y. et al., "Molecular analysis of the pathophysiological binding of the platelet aggregation-inducing factor podoplanin to the C-type lectin-like receptor CLEC-2", Cancer Sci, Jan. 2008, vol. 99, No. 1, pp. 54-61.
"Kawaguchi, M. et al., "Differential activation through the TCR-CD3 complex affects the requirement for costimulation of human T cells", Hum Immunol., 1995, vol. 43, No. 2, pp. 136-148".
Kellner et al.: Enhancing natural killer cell-mediated lysis of lymphoma cells by combining therapeutic antibodies with CD20-specific immunoligands engaging NKG2D or NKp30. Oncoimmunology 5(1 )e1058459 [1-12] (2016).
"Kerkela, E. et al., "Expression of Human Macrophage Metalloelastase (MMP-12) by Tumor Cells in Skin Cancer", Journal of Investigative Dermatology, 2000, vol. 114, No. 6, pp. 1113-1119".
Kirkin, et al. Melanoma-associated antigens recognized by cytotoxic T lymphocytes. APMIS. Jul. 1998;106(7):665-79.
Kitaura, K. et al., "A new high-throughput sequencing method for determining diversity and similarity of T cell receptor (TCR) α and β repertoires and identifying potential new invariant TCR a chains," BMC Immunology, 2016, vol. 17, No. 38, pp. 1-16.
Klampfl, T. et al., "Somatic Mutations of Calreticulin in Myeloproliferative Neoplasms", N Engl J Med., 2013, vol. 369, No. 25, pp. 2379-2390.
"Klein, C. et al., "Progress in overcoming the chain association issue in bispecific heterodimeric IgG antibodies", mAbs, 2012, vol. 4, No. 6, pp. 653-663".
Koch et al.: Activating natural cytotoxicity receptors of natural killer cells in cancer and infection. Trends Immunol. 34(4):182-191 doi:10.1016/j.it.2013.01.003 (2013).
Kunkel, Thomas A., "Rapid and efficient site-specific mutagenesis without phenotypic selection", Proc Natl Acad Sci, 1985, vol. 82, No. 2, pp. 488-492.
Kushner et al.: Aberrant expression of cyclin A and cyclin B1 proteins in oral carcinoma. J Oral Pathol Med. 28(2):77-81 (1999).
"Labrijn, A. et al., "Controlled Fab-arm exchange for the generation of stable bispecific IgG1", Nature Protocols, 2014, vol. 9, No. 10, pp. 2450-2463".
"Labrijn, A. et al., "Efficient generation of stable bispecific IgG1 by controlled Fab-arm exchange", PNAS, 2013, vol. 113, No. 13, pp. 5145-5150".
Lain et al.: Accumulating active p53 in the nucleus by inhibition of nuclear export: a novel strategy to promote the p53 tumor suppressor function. Exp Cell Res. 253(2):315-324 (1999).
"Langer, Robert, "New Methods of Drug Delivery", Science, 1990, vol. 249, No. 4976, pp. 1527-1533".
"Langer, R.S. et al., "Chemical and Physical Structure of Polymers as Carriers for Controlled Release of Bioactive Agents: a Review", J. Macromol. Sci. Rev. Macromol. Chem., 1983, vol. 23, No. 1, pp. 61-126".
"Langer, R.S. et al., "Medical Applications of Controlled Release", 1984, vol. 2, pp. 115-138".
Lee, C. M. et al., "Selection of human antibody fragments by phage display", Nat Protoc., 2007, vol. 2, No. 11, pp. 3001-3008.
Leong et al.: Optimized expression and specific activity of IL-12 by directed molecular evolution. Proc. Natl. Acad. Sci. USA; 100(3): 1163-1168 (2003).
Leutkens et al.: Functional autoantibodies against SSX-2 and NY-ESO-1 in multiple myeloma patients after allogeneic stem cell transplantation. Cancer Immunol Immunother. 63(11):1151-1162 (2014).

(56) References Cited

OTHER PUBLICATIONS

"Levy, R.J. et al., "Inhibition of Calcification of Bioprosthetic Heart Valves by Local Controlled-Release Diphosphonate", Science, 1985, vol. 228, No. 4696, pp. 190-192".
Li, B. et al., "Landscape of tumor-infiltrating T cell repertoire of human cancers," Nature Genetics, 2016, vol. 48, No. 7, pp. 725-735.
"Li, H. et al., "Tumor Microenvironment: the Role of the Tumor Stroma in Cancer", Journal of Cellular Biochemistry, 2007, vol. 101, pp. 805-815".
Li P. et al., "Design and synthesis of paclitaxel conjugated with an ErbB2-recognizing peptide," EC-1, 2007, Biopolymers, vol. 87, No. 4, pp. 225-230.
Liddy et al.: Monoclonal TCR-redirected tumor cell killing. Nat Med. 18(6):980-987 doi:10.1038/nm.2764 (2012).
Liu, A. et al., "Production of a mouse-human chimeric monoclonal antibody to CD20 with potent Fc-dependent biologic activity", J Immunol, 1987, vol. 139, No. 10, pp. 3521-3526.
Liu, A.Y. et al., "Chimeric mouse-human IgG1 antibody that can mediate lysis of cancer cells", PNAS, 1987, vol. 84, pp. 3439-3443.
Liu, D.Z. et al., "Synthesis of 2'-paclitaxel 2-glucopyranosyl succinate for specific targeted delivery to cancer cells", Bioorganic & Medicinal Chemistry Letters, 2007, vol. 17, pp. 617-620.
"Liu, J. et al., "Calcineurin is a common target of cyclophilin-cyclosporin A and FKBP-FK506 complexes", Cell, 1991, vol. 66, pp. 807-815".
Lobuglio, A. et al., "Phase I Clinical Trial of CO17-1A Monoclonal Antibody", Hybridomia, 1986, vol. 5, No. 1, pp. S117-S123.
Lonberg, N. et al., "Antigen-specific human antibodies from mice comprising four distinct genetic modifications", Nature, 1994, vol. 368, pp. 856-859.
Luo, S. et al., "Worldwide genetic variation of the IGHV and TRBV immune receptor gene families in humans" (2019) Life Sciences Alliance, vol. 2, No. 2, p. 1-9.
Maciocia, P. M. et al., "Targeting the T cell receptor B-chain constant region for immunotherapy of T cell malignancies", Nature Medicine, 2017, vol. 23, No. 12, pp. 1416-1423.
Macor, P. et al., "Bispecific antibodies targeting tumor-associated antigens and neutralizing complement regulators increase the efficacy of antibody-based immunotherapy in mice", Leukemia, 2015, vol. 29, pp. 406-414.
Mandelboim, O. et al., "Recognition of hemagglutinins on virus-infected cells by NKp46 activates lysis by human NK cells", Nature, 2001, vol. 409, No. 6823, pp. 1055-1060.
Mao et al.: Inhibition of human natural killer cell activity by influenza virions and hemagglutinin. Journal of Virology 84(9 ):4148-4157 (2010).
"Martens, T. et al., "A Novel One-Armed Anti-c-Met Antibody Inhibits Glioblastoma Growth In vivo", Clin Cancer Res, 2006, vol. 12, No. 20, pp. 6144-6152".
Martin, A. et al., "Chapter 3: Protein Sequence and Structure Analysis of Antibody Variable Domains", In: Antibody Engineering Lab Manual (Ed: Duebel, S. and Kontermann, R., Springer-Verlag, Heidelberg), 2010, vol. 2, pp. 33-51.
Martin, F. et al., "The affinity-selection of a minibody polypeptide inhibitor of human interleukin-6", EMBO J., 1994, vol. 13, No. 22, pp. 5303-5309.
McConnell, S.J. et al., "Tendamistat as a scaffold for conformationally constrained phage peptide libraries", J Mol Biol, 1995, vol. 250, No. 4, pp. 460-470.
McElroy et al.: Structural and Biophysical Studies of the Human IL-7/IL-7R alpha Complex. Structure 17(1):54-65 (2009).
Meschendoerfer, W. et al., "SPR-based assays enable the full functional analysis of bispecific molecules," Journal of Pharmaceutical and Biomedical Analysis, 2017, vol. 5, No. 132, pp. 141-147.
Meyers, E. et al., "Optimal alignments in linear space", CABIOS, 1988, vol. 4, No. 1, pp. 11-17.
"Michelacci, Y. et al., "A Comparative Study Between a Chondroitinase B and a Chondroitinase AC from Flavobacterium heparinum", Biochem J., 1975, vol. 151, pp. 121-129".
Michelacci, Y. et al., "Isolation and Partial Characterization of an Induced Chondroitinase B from Flavobacterium Heparinum", Biochemical and Biophysical Research Communications, 1974, vol. 56, No. 4, pp. 973-980.
Miller et al.: Trispecific Killer Engagers (TrikEs) that contain IL-15 to make NK cells antigen specific and to sustain their persistence and expansion. Blood 126(23):232-232 (2015).
"Milone, M. C. et al., "Chimeric receptors containing CD137 signal transduction domains mediate enhanced survival of T cells and increased antileukemic efficacy in vivo", Mol. Ther., 2009, vol. 17, No. 8, pp. 1453-1464".
Modak et al.: Disialoganglioside GD2 and a novel tumor antigen: potential targets for immunotherapy of desmoplastic small round cell tumor. Med Pediatr Oncol. 39(6):547-551 (2002).
"Moore, G. et al., "A novel bispecific antibody format enables simultaneous bivalent and monovalent co-engagement of distinct target antigens", mAbs, 2011, vol. 3, No. 6, pp. 546-557".
Morel et al.: Processing of some antigens by the standard proteasome but not by the immunoproteasome results in poor presentation by dendritic cells. Immunity. 12(1):107-117 doi:10.1016/s1074-7613(00)80163-6 (2000).
Morrison, Sherie L., "Transfectomas provide novel chimeric antibodies", Science, 1985, vol. 229, No. 4719, pp. 1202-1207.
Morrison, S.L. et al., "Chimeric human antibody molecules: Mouse antigen-binding domains with human constant region domains", Proc Natl Acad Sci, 1984, vol. 81, pp. 6851-6855.
Murer, P. et al., "Antibody-cytokine fusion proteins: a novel class of biopharmaceuticals for the therapy of cancer and of chronic inflammation", New Biotechnology, 2019, vol. 52, pp. 42-53.
"Murzin, A. G. et al., "SCOP: a structural classification of proteins database for the investigation of sequences and structures," J. Mol. Biol., 1995, vol. 247, pp. 536-540".
Nagarajan et al.: Ligand binding and phagocytosis by CD16 (Fc gamma receptor III) isoforms. Phagocytic signaling by associated zeta and gamma subunits in Chinese hamster ovary cells. Journal of Biological Chemistry J Biol Chem. 270(43):25762-25770 (1995).
Naing, et al., "Strategies for improving the management of immune-related adverse events" Journal for Immuno Therapy of Cancer, (2020) p. 1-9.
Nandi et al.: CD28-mediated costimulation is necessary for optimal proliferation of murine NK cells. J Immunol. 152(7):3361-3369 (1994).
Nangalia, J. et al., "Somatic CALR Mutations in Myeloproliferative Neoplasms with Nonmutated JAK2", N Engl J Med., 2013, vol. 369, No. 25, pp. 2391-2405.
Needleman, S. et al, "A General Method Applicable to the Search for Similarities in the Amino Acid Sequence of Two Proteins", J. Mol. Biol., 1970, vol. 48, pp. 444-453.
Newman et al.: Combining Early Heat Shock Protein Vaccination with Directed IL-2 Leads to Effective Anti-Tumor Immunity in Autologous Hematopoietic Cell Transplantation Recipients. 118(21):998-998 (2011).
Nishimura, Y. et al., "Recombinant Human-Mouse Chimeric Monoclonal Antibody Specific for Common Acute Lymphocytic Leukemia Antigen", Canc. Res, 1987, vol. 47, pp. 999-1005.
"No Author "Pe anti-human TCR VB23 Antibody" (2012)".
"No Author "Pe anti-mouse Tcr VB6 Antibody" (2012)".
Nolo, R. et al., "Targeting p. selection blocks neuroblastoma growth", Oncotarget, 2017, vol. 8, No. 49, pp. 86657-86670.
Novellino et al.: A listing of human tumor antigens recognized by T cells: Mar. 2004 update. Cancer Immunol Immunother. 54(3):187-207 doi:10.1007/s00262-004-0560-6 (2005).
"Oh, J. et al., "Single variable domains from the T cell receptor β chain function as mono- and bifunctional CARs and TCRs", Scientific Reports, 2019, vol. 9, No. 1, pp. 1-12".
Oi, V. et al., "Chimeric Antibodies", BioTechniques, 1986, vol. 4, No. 3, pp. 214-221.
"Ortiz-Sanchez, E. et al., "Antibody-cytokine fusion proteins: applications in cancer therapy," Expert Opin Biol Ther, 2008, vol. 8, No. 5, pp. 609-632".
"Page, et al., "Deep Sequencing of T-cell Receptor DNA as a biomarker of Clonally Expanded TILs in Breast Cancer after Immunotherapy" (2016) Cancer Immunolo Res 4: pp. 835-844".

(56) References Cited

OTHER PUBLICATIONS

Pardoll, D.M., "The blockade of immune checkpoints in cancer immunotherapy", Nat Rev Cancer, 2012, Vo. 12, pp. 252-264.
Park, Y.P. et al., "Complex Regulation of human NKG2D-DAP10 cell surface expression: opposing roles of the γc cytokines and TGF-β1", Blood, 2011, vol. 118, No. 11, pp. 3019-3027.
Paul, S. et al., "TCR beta chain-directed bispecific antibodies for the treatment of T-cell cancers," Science Translational Medicine, 2021, pp. 1-21.
Payne, J. et al., "Two Monoclonal Rat Antibodies with Specificity for the β -Chain Variable Region VB6 of the Murine T-Cell Receptor", Proc. Natl. Acad. Sci., 1988, vol. 85, pp. 7695-7698.
PCT/US2019/022284 International Preliminary Report on Patentability dated Sep. 15, 2020.
PCT/US2019/022284 International Search Report and Written Opinion dated Sep. 10, 2019.
PCT/US2020/019324 International Preliminary Report on Patentability dated Aug. 10, 2021.
PCT/US2020/019324 International Search Report and Written Opinion dated Jun. 10, 2020.
Pettit et al.: Structure-function studies of interleukin 15 using site-specific mutagenesis, polyethylene glycol conjugation, and homology modeling. J Biol Chem. 272(4):2312-2318 (1997).
"Pilch, et al., "Improved Assessment of T-Cell Receptor (TCR) VB Repertoire in clinical Specimens: Combination of TCR-CDR3 Spectratyping with Flow Cytometry-Based TCR VB Frequency Analysis" (2002) Clinical and Diagnostic Laboratory Immunology, p. 257-266".
"Presta, Leonard, "Antibody engineering", Curr. Op. Struct. Biol., 1992, vol. 2, No. 4, pp. 593-596".
Provenzano et al.: Enzymatic targeting of the stroma ablates physical barriers to treatment of pancreatic ductal adenocarcinoma. Cancer Cell. 21(3):418-429 doi:10.1016/j.ccr.2012.01.007 (2012).
Rakoff-Nahoum, S. et al., "Toll-like receptors and cancer", Nat Revs Cancer, 2009, vol. 9, pp. 57-63.
Rath, et al., "Engineering Strategies to Enhance TCR-Based Adoptive T Cell Therapy" (2020) Cells, 9, 1485, p. 1-34.
Reiter, Y et al., "Antibody Engineering of Recombinant Fv Immunotoxins for Improved Targeting of Cancer: Disulfide-stabilized Fv Immunotoxins", Clin Cancer Res, 1996, vol. 2, pp. 245-252.
Ridgway, J. et al, Knobs-into holes engineering of antibody CH3 domains for heavy chain heterodimerization, Protein Engineering, 1996, vol. 9, No. 7. pp. 617-621.
"Riechmann, L. et al., "Reshaping human antibodies for therapy", Nature, 1988, vol. 332, No. 24, pp. 323-327".
Ring et al.: Mechanistic and structural insight into the functional dichotomy between interleukin-2 and interleukin-15. Nat Immunol. 13(12):1187-1195 (2012).
Roda-Navarro, P. et al., "Understanding the Spatial Topology of Artificial Immunology Synapses Assembled in T Cell-Redirecting Strategies: a Major Issue in Cancer Immunotherapy", Frontiers in Cell and Developmental Biology, 2020, vol. 7, No. 370.
Rohena-Rivera et al.: IL-15 regulates migration, invasion, angiogenesis and genes associated with lipid metabolism and inflammation in prostate cancer. PloS one 12(4):e0172786:1-27 (2017).
Rosenberg, S. et al., "Use of Tumor-Infiltrating Lymphocytes and Interleukin-2 in the Immunotherapy of Patients with Metastatic Melanoma", New Eng J of Med, 1988, vol. 319, pp. 1676-1680.
Rudikoff, S. et al., "Single amino acid substitution altering antigen-binding specificity", Proc. Natl. Acad. Sci., 1982, vol. 19, pp. 1979-1983.
"Ruggiero, et al., "High-resolution analysis of the human T-cell receptor repertoire" Nature Communication (2014) p. 1-7".
Salameire, et al., "Accurate detection of the tumor clone in peripheral T-cell lymphoma biopsies by flow cytometric analysis of TCR-V B repertoire" Modern Pathology (2012) 25, p. 1246-1257.
Saleh, M.N. et al., "A phase II trial of murine monoclonal antibody 17-1A and interferon-γ: clinical and immunological data", Cancer Immunol Immunother, 1990, vol. 32, pp. 185-190.
Saudek, C. D. et al.,"A preliminary trial of the programmable implantable medication system for insulin delivery", The New England Journal of Medicine, 1989, vol. 321, No. 9, pp. 574-579.
Saunders K.O., "Conceptual Approaches to Modulating Antibody Effector Functions and Circulation Half-Life", Front Immunol., 2019, vol. 10, No. 1296, pp. 1-20.
Schleinitz N. et al., "Natural killer cells in human autoimmune diseases," Immunology, 2010;131(4):451-458.
Schliemann et al.: Targeting interleukin-2 to the bone marrow stroma for therapy of acute myeloid leukemia relapsing after allogeneic hematopoietic stem cell transplantation. Cancer immunology research 3(5 ):547-556 (2015).
Scodeller, Pablo, "Hyaluronidase and other Extracellular Matrix Degrading Enzymes for Cancer Therapy: New Uses and Nano-Formulations", Journal of Carcinogenesis & Mutagenesis, 2014, vol. 5, No. 4, pp. 1-5.
Seidel, U. et al., "Natural killer cell mediated antibody-dependent cellular cytotoxicity in tumor immunotherapy with therapeutic antibodies", frontiers in IMMUNOLOGY, 2013, vol. 4, No. 76, pp. 1-8.
Shaw, D. et al., "Mouse/human chimeric antibodies to a tumor-associated antigen: biologic activity of the four human IgG subclasses", Journal of the National Cancer Institute, 1988, vol. 80, No. 19. pp. 1553-1559.
Skegro, D. et al., "Immunoglobulin domain interface exchange as a platform technology for the generation of Fc heterodimers and bispecific antibodies," J Biol Chem, 2017, vol. 292, No. 23, pp. 9745-9759.
Spiess, C. et al, "Alternative molecular formats and therapeutic applications for bispecific antibodies", Molecular Immunology, 2015, vol. 67, pp. 95-106.
Stauber et al.: Nuclear and cytoplasmic survivin: molecular mechanism, prognostic, and therapeutic potential. Cancer Res. 67(13):5999-6002 (2007).
Sun, L.K. et al., "Chimeric antibody with human constant regions and mouse variable regions directed against carcinoma-associated antigen 17-1A", PNAS, 1987, vol. 84, pp. 214-218.
Swencki-Underwood, B. et al., "Engineering human IL-18 with increased bioactivity and bioavailability," Cytokine, 2006, vol. 34, pp. 114-124.
Tang, et al., "Anti-TCR Antibody Treatment Activates a Novel Population of Nonintestinal CD8aa+TCRaB+ Regulatory T Cells and Prevents Experimental Autoimmune Encephalomyelitis" The Journal of Immunology (2007) p. 1-9.
"Tassev, D. V. et al., "Retargeting NK92 cells using an HLA-A2-restricted, EBNA3C-specific chimeric antigen receptor," Cancer Gene Ther, 2012, vol. 19, No. 2, pp. 84-100".
"Stein, et al., "A new monoclonal antibody (CAL2) detects CALRETICULIN mutations in formalin-fixed and paraffin-embedded bone marrow biopsies," Leukemia, Jul. 23, 2015, vol. 30, No. 1, pp. 131-135".
"Ten Hacken, et al., "Calreticulin as a novel B-cell receptor antigen in chronic lymphocytic leukemia," Haematologica, Oct. 31, 2017, vol. 102, No. 10, pp. E394-E396".
Thorpe, P. E., "Vascular Targeting Agents as Cancer Therapeutics", Clinc Cancer Res, 2004, vol. 10, pp. 415-427.
"Stivala, A. et al., "Automatic generation of protein structure cartoons with Pro-origami," Bioinformatics, 2011, vol. 27, No. 23, pp. 3315-3316".
Tomlinson, I. et al., "The repertoire of human germline vH sequences reveals about fifty groups of VH segments with different hypervariable loops", Journal of Molecular Biology, 1992, vol. 227, No. 3, pp. 776-798.
Tramontano, A. et al., "The making of the minibody: an engineered B-protein for the display of conformationally constrained peptides", Journal of Molecular Recognition, 1994, vol. 7, pp. 9-24.
Trenevska et al.: Therapeutic Antibodies against Intracellular Tumor Antigens. Front Immunol. 8:1001 doi:10.3389/fimmu.2017.01001 [1-12] (2017).
Tuaillon, N. et al, Human immunoglobulin heavy-chain minilocus recombination in transgenic mice: Gene-segment use in μ and γ transcripts, PNAS, 1993, vol. 90, pp. 3720-3724.

(56) References Cited

OTHER PUBLICATIONS

U.S. Appl. No. 17/529,017 Non-Final Office Action dated Apr. 27, 2022.
"Suzuki, S. et al., "Formation of Three Types of Disulfated Disaccharides from Chondroitin Sulfates by Chondroitinase Digestion", The Journal of Biological Chemistry, 1968, vol. 243, No. 7, pp. 1543-1550".
Vallera et al.: Heterodimeric bispecific single-chain variable-fragment antibodies against EpCAM and CD16 induce effective antibody-dependent cellular cytotoxicity against human carcinoma cells. Cancer Biother Radiopharm. 28(4):274-282 doi:10.1089/cbr.2012.1329 (2013).
Vannucchi, et al., "Calreticulin mutation-specific immunostaining in myeloproliferative neoplasms: pathogenetic insight and diagnostic value" Leukemia (2014) 28, p. 1811-1818.
Verhoeyen, M. et al., "Reshaping Human Antibodies: Grafting an Antilysozyme Activity", Science, 1988, vol. 239, pp. 1534-1536.
"Verma, B. et al., "TCR Mimic Monoclonal Antibody Targets a Specific Peptide/HLA Class I Complex and Significantly Impedes Tumor Growth In Vivo Using Breast Cancer Models," J Immunol, 2010, vol. 184, No. 4, pp. 2156-2165".
"Vonderheid, et al., "Evidence for Restricted VB Usage in the Leukemic Phase of Cutaneous T Cell Lymphoma" (2015) The Society for Investigative Dermatology, Inc. p. 650-661".
Vyas, M. et al., "Natural ligands and antibody-based fusion proteins: harnessing the immune system against cancer", Trends in Molecular Medicine, 2014, vol. 20, No. 2, pp. 72-82.
Wagner, E.K. et al., "Engineering therapeutics antibodies to combat infectious disease," Current Opinion in Chemical Engineering, 2018:19;131-141.
"Wang, C.Y. et al., "αβ T-cell receptor bias in disease and therapy (Review)", International Journal of Oncology, 2016, vol. 48, pp. 2247-2256".
Wang et al.: Cloning genes encoding MHC class II-restricted antigens: mutated CDC27 as a tumor antigen. Science 284(5418):1351-1354 doi:10.1126/science.284.5418.1351 (1999).
Wang et al.: RNA interference targeting CML66, a novel tumor antigen, inhibits proliferation, invasion and metastasis of HeLa cells. Cancer Lett. 269(1):127-138 (2008).
Wang, H. et al., "Preparation and functional identification of a monoclonal antibody against the recombinant soluble human NKp30 receptor," Internal Immunopharmacology, 2011;11(11):1732-1739.
Warren, H.S. et al., "Evidence that the cellular ligand for the Human NK Cell Activation Receptor NKp30 is not a Heparan Sulfate Glycosaminoglycan," The Journal of Immunology, 2005;175(1):207-212.
Wei, S. et al., "Identification of a novel human T-cell receptor VB subfamily by genomic cloning", Human Immunology, 1994, vol. 41, No. 3, pp. 201-206.
Weidle, U. et al., "The Intriguing Options of Multispecific Antibody Formats for Treatment of Cancer", Cancer Genomics & Proteomics, 2013, vol. 1, pp. 1-18.
Weidle, U.H. et al., "Tumor-Antigen-Binding Bispecific Antibodies for Cancer Treatment", Seminars in Oncology, 2014, vol. 41, No. 5, pp. 653-660.
"Williemsen, R. A. et al., "A phage display selected Fab fragment with MHC class I-restricted specificity for MAGE-A1 allows for retargeting of primary human T lymphocytes," Gene Therapy, 2001, vol. 8, No. 21, pp. 1601-1608".
Wood, C. R. et al., "The synthesis and in vivo assembly of functional antibodies in yeast", Nature Publishing Group, 1985, vol. 314, No. 4, pp. 446-449.
Wu, M.R. et al., "B7H6-Specific Bispecific T Cell Engagers Lead to Tumor Elimination and Host Antitumor Immunity", The Journal of Immunology, 2015, vol. 194, No. 11, pp. 5305-5311.
Wurzer et al.: Nuclear Ras: unexpected subcellular distribution of oncogenic forms. J Cell Biochem Suppl. Suppl 36:1-11 doi:10.1002/jcb.1070 (2001).
Xiao, Y.F. et al., "Peptide-based treatment: a promising cancer therapy", Journal of Immunology Research, 2015, pp. 1-14.
Xiaoying, C. et al., "Fusion protein linkers: Property, design and functionality", Advanced Drug Delivery Reviews, 2012, vol. 65, No. 10, pp. 1357-1369.
"Xu, X. et al., "Cytokine release syndrome in cancer immunotherapy with chimeric antigen receptor engineered T cells", Cancer Letters, 2014, vol. 343, No. 2, pp. 172-178".
"Yamagata, T. et al., "Purification and Properties of Bacterial Chondroitinases and Chondrosulfatases", The Journal of Biological Chemistry, 1968, vol. 243, No. 7, pp. 1523-1535".
"Yassai, M. et al., "A clonotype nomenclature for T cell receptors", Immunogenetics, 2009, vol. 61, pp. 493-502".
Yoon et al.: Charged residues dominate a unique interlocking topography in the heterodimeric cytokine interleukin-12. The EMBO J. 19(14):3530-3541 (2000).
Zhang, T. et al., "Cancer Immunotherapy Using a Bispecific NK Receptor Fusion Protein that Engages both T Cells and Tumor Cells", Cancer research, 2011, vol. 71, No. 6, pp. 2066-2076.
Al-Aghbar, M.A. et al., "High-affinity ligands can trigger T cell receptor signaling without CD45 segregation," Frontiers in Immunology, 2018;9(713):1-18.
Bolt, S. et al., "The generation of a humanized, non-mitogenic CD3 monoclonal antibody which retains in vitro immunosuppressive properties," Eur. J. Immunol., 1993;23:403-411.
Breman, E. et al., "Overcoming target driven fratricide for T Cell Therapy," Frontiers in Immunology, 2018;9(2940):1-11.
Chiang, E. et al., "Abstract 3527: Potent anti-tumor activity of AbGn-100, an anti-CD326 x anti-TCR bispecific antibody to CD326-expressing solid tumors," Cancer Res., 2012;72(8_supplement):3527.
Chichili, V.P.R. et al., "Linkers in the structural biology of protein-protein interactions," Protein Science, 2013;22:153-167.
Cho, Bryan, et al., Single-Chain Fv/Folate Conjugates Mediate Efficient Lysis of Folate-Receptor-Positive Tumor Cells. Bioconjugate Chemistry 8(3):338-346 (1997).
Ciccone, E. et al., "A monoclonal antibody specific for a common determinant of the human T cell receptor gamma/delta directly activates CD3+WT31- lymphocytes to express their functional program(s)," J Exp Med., 1988;168(1):1-11.
El Achi, H. et al., "CD123 as a Biomarker in Hematolymphoid Malignancies: Principles of Detection and Targeted Therapies," Cancers, 2020;12(11):3087.
Foley, K. et al., Combination immunotherapies implementing adoptive T-cell transfer for advanced-stage melanoma, Melanoma Research, vol. 28, 3 (2018): 171-184.
Geissinger, E. et al., "Identification of the Tumor Cells in Peripheral T-Cell Lymphomas by Combined Polymerase Chain Reaction-Based T-Cell Receptor [3 Spectrotyping and Immunohistological Detection with T-Cell Receptor [3 Chain Variable Region Segment-Specific Antibodies," J. of Mol Diag., 2005;7(4):455-464.
Gillies, S.D. et al., "Bi-functional cytokine fusion proteins for gene therapy and antibody-targeted treatment of cancer," Cancer Immunol Immunotherapy, 2002;51:449-460.
Goel, M. et a., "Plasticity within the Antigen-Combining site may manifest as molecular mimicry in the humoral immune response," J Immunology, 2004;173(12):7358-7367.
Gohal, G. et al., "T-cell receptor phenotype pattern in atopic children using commercial fluorescently labeled antibodies against 21 human class-specific v segments for the terβ chain (vβ) of peripheral blood: a cross sectional study," Allergy Asthma Clin Immunol., 2016;12:10.
Gordon, E.D. et al., "Alternative splicing of interleukin-33 and type 2 inflammation in asthma," PNAS, 2016;113(31):8765-8770.
Gulley, J.L. et al., "New drugs on the horizon," Eur J Cancer, 2022;174(S1):S5.
Gupta, S. et al., "T cell activation via the T cell receptor: a comparison between WT31 (defining alpha/beta TcR)-induced and anti-CD3-induced activation of human T lymphocytes," Cell Immunol., 1991;132(1):26-44.
Halin, C. et al., "Synergistic Therapeutic Effects of a Tumor Targeting Antibody Fragment, Fused to Interleukin 12 and to Tumor Necrosis Factor a1," Cancer Research, 2003;63:3202-3210.
Hombach, A.A. et al., "Antibody-IL2 Fusion Proteins for Tumor Targeting," Antibody Engineering, 2012:611-626.

(56) References Cited

OTHER PUBLICATIONS

Hudson, K.R. et al., "Two Adjacent Residues in Staphylococcal EnterotoxIns A and E Determine T Cell Receptor Vbeta Specificity," J.Exp. Med., 1993;177:175-184.
Jiang, B. et al., "A novel peptide isolated from a phage display peptide library with trastuzumab can mimic antigen epitope of HER-2*," The Journal of Biological Chemistry, 2005;280(6):4656-4662.
Kiefer, J.D. et al., "Immunocytokines and bispecific antibodies: two complementary strategies for the selective activation of immune cells at the tumor site," Immunol Rev., 2016;270(1):178-192.
Kim, E.J. et al., "Interleukin-2 fusion protein with anti-CD3 single-chain Fv (sFv) selectively protects T cells from dexamethasone-induced apoptosis," Vaccine, 2002;20:608-615.
Lanier, L.L. et al., "Distinct epitopes on the t cell antigen receptor of HPB-ALL tumor cells identified by monoclonal antibodies," 1986;137(7):2286-2292.
Leclercq, G. et al., "Dissecting the mechanism of cytokine release induced by T-cell engagers highlights the contribution of neutrophils," Oncoimmunology, 2022;11(1):e2039432.
Lee, K.D. et al., "Construction and characterization of a novel fusion protein consisting of anti-CD3 antibody fused to recombinant interleukin-2," Oncology Reports, 2006;15:1211-1216.
Leonard, E.K. et al., "Engineered cytokine/antibody fusion proteins improve delivery of IL-2 to pro-inflammatory cells and promote antitumor activity," bioRxiv, 2023:1-36.
Li, F. et al., "T cell receptor B-chain-targeting chimeric antigen receptor T cells against T cell malignancies," Nature Communications, 2022;13:4334.
Liu, D.V. et al., "Engineered Interleukin-2 Antagonists for the Inhibition of Regulatory T Cells," J. Immunother., 2009;32(9):887-894.
Liu, K. et al., "CD123 and its potential clinical application in leukemias," Life Sciences, 2015;122:59-64.
Lloyd et al., Modelling the Human Immune Response: Performance of a 10" Human Antibody Repertoire Against a Broad Panel of Therapeutically Relevant Antigens. Protein Engineering Design & Selection. 22(3):159-168 (2009).
Lustgarten, J. et al., "Redirecting Effector T Cells through their IL-2 receptors," J Immunology, 1999;162:359-365.
MacKay, C.R. et al., "Gamma/delta T cells express a unique surface molecule appearing late during thymic development," Eur J Immunol., 1989;19(8):1477-1483.
Merchant, A.M. et al., "An efficient route to human bispecific IgG," Nature Biotechnology, 1998;16(7):677-681.
Mitra, S. et al., "Interleukin-2 Activity can be Fine-Tuned with Engineering Receptor Signaling Clamps," Immunity, 2015;42(5):826-838.
Miyahara, Y et al., Anti-TCRB mAb induces long-term allograft survival by reducing antigen-reactive T cells and sparing regulatory T cells, American journal of transplantation: official Journal of the American Society of Transplantation and the American Society of Transplant Surgeons, vol. 12, 6 (2012): 1409-18.
Muller, K P, et al., T Cell Receptor Targeting to Thymic Cortical Epithelial Cells in Vivo Induces Survival, Activation and Differentiation of Immature Thymocytes. European Journal of Immunology 23(7):1661-1670 (1993).
Niederberger, N. et al., "Thymocyte stimulation by anti-TCR-b, but not by anti-TCR-a, leads to induction of developmental transcription program," Journal of Leukoeyte Biology, 2005;77(5):830-841.
Pasche, N. et al., "Immunocytokines: a novel class of potent armed antibodies," Drug Discovery Today, 2012;17(11):583-590.
Posnett, D.N. et al., "Inherited polymorphism of the human T-cell antigen receptor detected by a monoclonal antibody," PNAS, 1986;83:7888-7892.
Qi, et al., "Potent and selective antitumor activity of a T cell-engaging bispecific antibody targeting a membrane-proximal epitope of ROR1," PNAS, 2018;115(24):E5467-E5476.
Rabia, L. et al., "Understanding and overcoming trade-offs between antibody affinity, specificity, stability and solubility," Biochemical Engineering Journal, 2018;137:365-374.
Riemer, A.B. et al., "Matching of trastuzumab (Herceptin) epitope mimics onto the surface of Her-2/neu—a new method of epitope definition," Molecular Immunology, 2005;42:1121-1124.
Sano, Y. et al., "Properties of Blocking and Non-blocking Monoclonal Antibodies Specific for Human Macrophage Galactose-type C-type Lectin (MGL/ClecSF10A/CD301)," J. Biochem., 2007;127-136.
Sekine, T. et al., "A feasible method for expansion of peripheral blood lymphocytes by culture with immobilized anti-CD3 monoclonal antibody and interleukin-2 for use in adoptive immunotherapy of cancer patients," Biomed & Pharmacother, 1993;47:73-78.
Sen, S. et al., "Expression of epithelial cell adhesion molecule (EpCAM) in oral squamous cell carcinoma," Histopathology, 2015:6:897-904. Abstract only.
Shi, M. et al., "A recombinant anti-erbB2, scFv-Fc-IL-2 fusion protein retains antigen specificity and cytokine function," Biotechnology letters, 2003;25:815-819.
Stauber, D.J. et al., "Crystal structure of the IL-2 signaling complex: Paradigm for a heterotrimeric cytokine receptor," PNAS, 2006;103(8):2788-2793.
Tomonari, K. et al., "Epitope-specific binding of CD8 regulates activation of T cells and induction of cytotoxicity," International Immunology, 1990;2(12):1189-1194.
Tsytsikov, V.N. et al., "Identification and Characterization of Two Alternative Splice Variants of Human Interleukin-2*" The Journal of Biological Chemistry, 1996;71(38):23055-23060.
Verwilghen, J. et al., "Differences in the stimulating capacity of immobilized anti-CD3 monoclonal antibodies: variable dependence on interleukin-1 as a helper signal for T-cell activation," 1991;72:269-276.
Wadia, P. et al., "Impaired lymphocyte responses and their restoration in oral cancer patients expressing distinct TCR variable region," Cancer Investigation, 2008;26:471-480.
Wan, Y.Y. et al., "Yin-Yang' functions of TGF-b and tregs in immune regulation," Immunol Rev., 2007;220:199-213.
Yoon, S.T. et al., "Both high and low avidity antibodies to the T cell receptor can have agonist or antagonist activity," Immunity, 1994;1(7):563-569.
Bisikirska, Brygida. et al. TCR stimulation with modified anti-CD3 mAb expands CD8+ T cell population and induces CD8+CD25+ Tregs. The Journal of clinical investigation 115(10):2904-2913 (2005).
Cassard, et al. Fc gamma receptors and cancer. In: Springer seminars in immunopathology, vol. 28, No. 4, pp. 321-328 (2006). Berlin/Heidelberg: Springer-Verlag.
Co-pending U.S. Appl. No. 19/333,088, inventors Katragadda; Madan et al., filed Sep. 18, 2025.
Co-pending U.S. Appl. No. 19/339,740, inventors Tan; Seng-Lai et al., filed Sep. 25, 2025.
Co-pending U.S. Appl. No. 19/370,251, inventors Katragadda; Madan et al., filed Oct. 27, 2025.
Co-pending U.S. Appl. No. 19/408,507, inventor Bayliffe; Andrew, filed Dec. 4, 2025.
Dehghanpisheh, K, and J J Marchalonis. Retrovirally induced mouse anti-TCR monoclonals can synergize the in vitro proliferative T cell response to bacterial superantigens. Scandinavian journal of immunology 45(6):645-654 (1997).
Gaston, R S. et al. OKT3 first-dose reaction: association with T cell subsets and cytokine release. Kidney international 39(1):141-148 (1991).
Gulley, et al. STAR0602, a novel TCR agonist antibody, demonstrates potent antitumor activity in refractory solid tumor models through the expansion of a novel, polyclonal effector memory T cell subset. European Journal of Cancer, 174, S5 (2022).
Hartley, John A. et al. Pre-clinical pharmacology and mechanism of action of SG3199, the pyrrolobenzodiazepine (PBD) dimer warhead component of antibody-drug conjugate (ADC) payload tesirine. Scientific reports 8(1):10479, 1-10 (2018).

(56) References Cited

OTHER PUBLICATIONS

Hou, Sheng. et al. Humanization of an anti-CD34 monoclonal antibody by complementarity-determining region grafting based on computer-assisted molecular modelling. J Biochem 144(1):115-120 (2008).
Kucuksezer, Umut Can. et al. The Role of Natural Killer Cells in Autoimmune Diseases. Frontiers in Immunology 12:622306, 1-23 (2021).
Lombana, T Noelle. et al. Optimizing antibody expression by using the naturally occurring framework diversity in a live bacterial antibody display system. Scientific Reports 5:17488, 1-14 (2015).
Nelson, et al. Tumor cells express Fc[gamma]RI which contributes to tumor cell growth and a metastatic phenotype. Neoplasia, 3(2), 115-124 (2001).
Olsen, Shaun K. et al. Crystal structure of the interleukin-15 interleukin-15 receptor alpha complex: insights into trans and cis presentation. Journal of Biological Chemistry 282(51):37191-37204 (2007).
PCT/US2025/024019 International Search Report and Written Opinion dated Oct. 2, 2025.
PCT/US2025/025263 International Search Report and Written Opinion dated Oct. 31, 2025.
Psaila, Bethan. et al. Single-Cell Analyses Reveal Megakaryocyte-Biased Hematopoiesis in Myelofibrosis and Identify Mutant Clone-Specific Targets. Mol Cell 78(3):477-492, e1-e8 (2020).
U.S. Appl. No. 17/402,318 Office Action dated Oct. 16, 2025.
U.S. Appl. No. 17/745,456 Office Action dated Dec. 31, 2025.
U.S. Appl. No. 18/341,688 Notice of Allowance dated Sep. 23, 2025.
Wei, Xiao-qing. et al. The sushi domain of soluble IL-15 receptor alpha is essential for binding IL-15 and inhibiting inflammatory and allogenic responses in vitro and in vivo. The Journal of Immunology 167(1):277-282 (2001).

* cited by examiner

VH

Framework 1 / CDR 1

| | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 | 35 |
|---|---|---|---|---|---|---|---|---|---|---|---|---|---|---|---|---|---|---|---|---|---|---|---|---|---|---|---|---|---|---|---|---|---|---|---|
| SEQ ID NO: 1 | Q | V | Q | L | Q | Q | S | G | P | E | L | V | K | P | G | T | S | V | K | I | S | C | K | A | S | G | Y | S | F | T | T | Y | Y | I | H |
| SEQ ID NO: 9 | Q | V | Q | L | V | Q | S | G | A | E | V | K | K | P | G | S | S | V | K | V | S | C | K | A | S | G | Y | S | F | T | T | Y | Y | I | H |

Framework 2 / CDR 2

| | 36 | 37 | 38 | 39 | 40 | 41 | 42 | 43 | 44 | 45 | 46 | 47 | 48 | 49 | 50 | 51 | 52 | 52a | 53 | 54 | 55 | 56 | 57 | 58 | 59 | 60 | 61 | 62 | 63 | 64 | 65 |
|---|---|---|---|---|---|---|---|---|---|---|---|---|---|---|---|---|---|---|---|---|---|---|---|---|---|---|---|---|---|---|---|
| SEQ ID NO: 1 | W | V | K | Q | R | P | G | Q | G | L | E | W | I | G | W | F | F | P | G | S | G | N | I | K | Y | N | E | K | F | K | G |
| SEQ ID NO: 9 | W | V | R | Q | A | P | G | Q | G | L | E | W | M | G | W | F | F | P | G | S | G | N | I | K | Y | N | E | K | F | K | G |

| | 66 | 67 | 68 | 69 | 70 | 71 | 72 | 73 | 74 | 75 | 76 | 77 | 78 | 79 | 80 | 81 | 82 | 82a | 82b | 82c | 83 | 84 | 85 | 86 | 87 | 88 | 89 | 90 | 91 | 92 | 93 | 94 |
|---|---|---|---|---|---|---|---|---|---|---|---|---|---|---|---|---|---|---|---|---|---|---|---|---|---|---|---|---|---|---|---|---|
| SEQ ID NO: 1 | K | A | T | L | T | A | D | T | S | S | S | T | A | Y | M | Q | L | S | S | L | T | S | E | E | S | A | V | Y | F | C | A | G |
| SEQ ID NO: 9 | R | V | T | I | T | A | D | T | S | T | S | T | A | Y | M | E | L | S | S | L | R | S | E | D | T | A | V | Y | Y | C | A | G |

CDR 3 / Framework 4

| | 95 | 96 | 97 | 98 | 99 | 100 | 100a | 100b | 101 | 102 | 103 | 104 | 105 | 106 | 107 | 108 | 109 | 110 | 111 | 112 | 113 |
|---|---|---|---|---|---|---|---|---|---|---|---|---|---|---|---|---|---|---|---|---|---|
| SEQ ID NO: 1 | S | Y | Y | S | Y | D | V | L | D | Y | W | G | H | G | T | T | L | T | V | S | S |
| SEQ ID NO: 9 | S | Y | Y | S | Y | D | V | L | D | Y | W | G | Q | G | T | T | V | T | V | S | S |

FIG. 4A

VL

Framework 1 (1–23) / CDR 1 (24–34)

| | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 |
|---|---|---|---|---|---|---|---|---|---|---|---|---|---|---|---|---|---|---|---|---|---|---|---|---|---|---|---|---|---|---|---|---|---|---|
| SEQ ID NO: 2 | D | I | L | M | T | Q | S | Q | K | F | M | S | T | S | L | G | D | R | V | S | V | S | C | *K* | *A* | *S* | *Q* | *N* | *V* | *G* | *I* | *N* | *V* | *V* |
| SEQ ID NO: 10 | D | I | Q | M | T | Q | S | P | S | E | L | S | A | S | V | G | D | R | V | T | I | T | C | *K* | *A* | *S* | *Q* | *N* | *V* | *G* | *I* | *N* | *V* | *V* |
| SEQ ID NO: 11 | D | I | Q | M | T | Q | S | P | S | S | L | S | A | S | V | G | D | R | V | T | I | T | C | *K* | *A* | *S* | *Q* | *N* | *V* | *G* | *I* | *N* | *V* | *V* |

Framework 2 (35–49) / CDR 2 (50–56)

| | 35 | 36 | 37 | 38 | 39 | 40 | 41 | 42 | 43 | 44 | 45 | 46 | 47 | 48 | 49 | 50 | 51 | 52 | 53 | 54 | 55 | 56 |
|---|---|---|---|---|---|---|---|---|---|---|---|---|---|---|---|---|---|---|---|---|---|---|
| SEQ ID NO: 2 | W | H | Q | Q | K | P | G | Q | S | P | K | A | L | I | Y | *S* | *S* | *S* | *H* | *R* | *Y* | *S* |
| SEQ ID NO: 10 | W | H | Q | Q | K | P | G | K | A | P | K | A | L | I | Y | *S* | *S* | *S* | *H* | *R* | *Y* | *S* |
| SEQ ID NO: 11 | W | H | Q | Q | K | P | G | K | V | P | K | A | L | I | Y | *S* | *S* | *S* | *H* | *R* | *Y* | *S* |

Framework 3 (57–88)

| | 57 | 58 | 59 | 60 | 61 | 62 | 63 | 64 | 65 | 66 | 67 | 68 | 69 | 70 | 71 | 72 | 73 | 74 | 75 | 76 | 77 | 78 | 79 | 80 | 81 | 82 | 83 | 84 | 85 | 86 | 87 | 88 |
|---|---|---|---|---|---|---|---|---|---|---|---|---|---|---|---|---|---|---|---|---|---|---|---|---|---|---|---|---|---|---|---|---|
| SEQ ID NO: 2 | G | V | P | D | R | F | T | G | S | G | S | G | T | D | F | T | L | T | I | N | N | V | Q | S | E | D | L | A | E | Y | F | C |
| SEQ ID NO: 10 | G | V | P | S | R | F | S | G | S | G | S | G | T | E | F | T | L | T | I | S | S | L | Q | P | E | D | F | A | T | Y | F | C |
| SEQ ID NO: 11 | G | V | P | S | R | F | S | G | S | G | S | G | T | D | F | T | L | T | I | S | S | L | Q | P | E | D | V | A | T | Y | F | C |

CDR 3 (89–97) / Framework 4 (98–107)

| | 89 | 90 | 91 | 92 | 93 | 94 | 95 | 96 | 97 | 98 | 99 | 100 | 101 | 102 | 103 | 104 | 105 | 106 | 107 |
|---|---|---|---|---|---|---|---|---|---|---|---|---|---|---|---|---|---|---|---|
| SEQ ID NO: 2 | *Q* | *Q* | *F* | *K* | *S* | *Y* | *P* | *L* | *T* | F | G | A | G | T | K | L | E | L | K |
| SEQ ID NO: 10 | *Q* | *Q* | *F* | *K* | *S* | *Y* | *P* | *L* | *T* | F | G | Q | G | T | K | L | E | I | K |
| SEQ ID NO: 11 | *Q* | *Q* | *F* | *K* | *S* | *Y* | *P* | *L* | *T* | F | G | Q | G | T | K | L | E | I | K |

FIG. 4B

VH

| | Framework 1 | | | | | | | | | | | | | | | | | | | | | | | | | CDR 1 | | | | | | | | | |
|---|---|---|---|---|---|---|---|---|---|---|---|---|---|---|---|---|---|---|---|---|---|---|---|---|---|---|---|---|---|---|---|---|---|---|---|
| | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 | 35 |
| SEQ ID NO: 15 | E | V | Q | L | V | E | S | G | G | G | L | V | Q | P | G | G | S | R | K | L | S | C | A | A | S | G | F | T | F | S | N | F | G | M | H |
| SEQ ID NO: 25 | Q | V | Q | L | V | E | S | G | G | G | V | V | Q | P | G | R | S | L | R | L | S | C | A | A | S | G | F | T | F | S | N | F | G | M | H |
| SEQ ID NO: 23 | E | V | Q | L | V | E | S | G | G | G | L | V | Q | P | G | G | S | L | R | L | S | C | A | A | S | G | F | T | F | S | N | F | G | M | H |
| SEQ ID NO: 24 | E | V | Q | L | V | E | S | G | G | G | L | V | Q | P | G | G | S | L | R | L | S | C | A | A | S | G | F | T | F | S | N | F | G | M | H |

| | Framework 2 | | | | | | | | | | | | | | CDR 2 | | | | | | | | | | | | | | | | |
|---|---|---|---|---|---|---|---|---|---|---|---|---|---|---|---|---|---|---|---|---|---|---|---|---|---|---|---|---|---|---|---|
| | 36 | 37 | 38 | 39 | 40 | 41 | 42 | 43 | 44 | 45 | 46 | 47 | 48 | 49 | 50 | 51 | 52 | 52a | 53 | 54 | 55 | 56 | 57 | 58 | 59 | 60 | 61 | 62 | 63 | 64 | 65 |
| SEQ ID NO: 15 | W | V | R | Q | A | P | D | K | G | L | E | W | V | A | Y | I | S | S | G | S | S | T | I | Y | Y | A | D | T | L | K | G |
| SEQ ID NO: 25 | W | V | R | Q | A | P | G | K | G | L | E | W | V | A | Y | I | S | S | G | S | S | T | I | Y | Y | A | D | T | L | K | G |
| SEQ ID NO: 23 | W | V | R | Q | A | P | G | K | G | L | E | W | V | S | Y | I | S | S | G | S | S | T | I | Y | Y | A | D | T | L | K | G |
| SEQ ID NO: 24 | W | V | R | Q | A | P | G | K | G | L | E | W | V | S | Y | I | S | S | G | S | S | T | I | Y | Y | A | D | T | L | K | G |

| | Framework 3 | | | | | | | | | | | | | | | | | | | | | | | | | | | | | | |
|---|---|---|---|---|---|---|---|---|---|---|---|---|---|---|---|---|---|---|---|---|---|---|---|---|---|---|---|---|---|---|---|
| | 66 | 67 | 68 | 69 | 70 | 71 | 72 | 73 | 74 | 75 | 76 | 77 | 78 | 79 | 80 | 81 | 82 | 82a | 82b | 82c | 83 | 84 | 85 | 86 | 87 | 88 | 89 | 90 | 91 | 92 | 93 | 94 |
| SEQ ID NO: 15 | R | F | T | I | S | R | D | N | P | K | N | T | L | F | L | Q | M | T | S | L | R | S | E | D | T | A | M | Y | Y | C | A | R |
| SEQ ID NO: 25 | R | F | T | I | S | R | D | N | S | K | N | T | L | Y | L | Q | M | N | S | L | R | A | E | D | T | A | V | Y | Y | C | A | R |
| SEQ ID NO: 23 | R | F | T | I | S | R | D | N | A | K | N | S | L | Y | L | Q | M | N | S | L | R | A | E | D | T | A | V | Y | Y | C | A | R |
| SEQ ID NO: 24 | R | F | T | I | S | R | D | N | S | K | N | T | L | Y | L | Q | M | N | S | L | R | A | E | D | T | A | V | Y | Y | C | A | R |

| | CDR 3 | | | | | | | | Framework 4 | | | | | | | | | | |
|---|---|---|---|---|---|---|---|---|---|---|---|---|---|---|---|---|---|---|---|
| | 95 | 96 | 97 | 98 | 99 | 100 | 101 | 102 | 103 | 104 | 105 | 106 | 107 | 108 | 109 | 110 | 111 | 112 | 113 |
| SEQ ID NO: 15 | R | G | E | G | A | M | D | Y | W | G | Q | G | T | S | V | T | V | S | S |
| SEQ ID NO: 25 | R | G | E | G | A | M | D | Y | W | G | Q | G | T | T | V | T | V | S | S |
| SEQ ID NO: 23 | R | G | E | G | A | M | D | Y | W | G | Q | G | T | T | V | T | V | S | S |
| SEQ ID NO: 24 | R | G | E | G | A | M | D | Y | W | G | Q | G | T | T | V | T | V | S | S |

FIG. 5A

VL

| | Framework 1 | | | | | | | | | | | | | | | | | | | | | | CDR 1 | | | | | | | | | | |
|---|---|---|---|---|---|---|---|---|---|---|---|---|---|---|---|---|---|---|---|---|---|---|---|---|---|---|---|---|---|---|---|---|---|
| | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 |
| SEQ ID NO: 16 | E | N | V | L | T | Q | S | P | A | I | M | S | A | S | L | G | E | K | V | T | M | S | C | *R* | *A* | *S* | *S* | *S* | *V* | - | *N* | *Y* | *I* | *Y* |
| SEQ ID NO: 26 | D | N | Q | L | T | Q | S | P | S | F | L | S | A | S | V | G | D | R | V | T | I | T | C | *R* | *A* | *S* | *S* | *S* | *V* | - | *N* | *Y* | *I* | *Y* |
| SEQ ID NO: 27 | D | N | Q | L | T | Q | S | P | S | S | L | S | A | S | V | G | D | R | V | T | I | T | C | *R* | *A* | *S* | *S* | *S* | *V* | - | *N* | *Y* | *I* | *Y* |
| SEQ ID NO: 28 | E | N | V | L | T | Q | S | P | A | T | L | S | V | S | P | G | E | R | A | T | L | S | C | *R* | *A* | *S* | *S* | *S* | *V* | - | *N* | *Y* | *I* | *Y* |
| SEQ ID NO: 29 | Q | N | V | L | T | Q | P | P | S | - | A | S | G | T | P | G | Q | R | V | T | I | S | C | *R* | *A* | *S* | *S* | *S* | *V* | - | *N* | *Y* | *I* | *Y* |
| SEQ ID NO: 30 | S | N | E | L | T | Q | P | P | S | - | V | S | V | S | P | G | Q | T | A | R | I | T | C | *R* | *A* | *S* | *S* | *S* | *V* | - | *N* | *Y* | *I* | *Y* |

| | Framework 2 | | | | | | | | | | | | | | | CDR 2 | | | | | | |
|---|---|---|---|---|---|---|---|---|---|---|---|---|---|---|---|---|---|---|---|---|---|---|
| | 35 | 36 | 37 | 38 | 39 | 40 | 41 | 42 | 43 | 44 | 45 | 46 | 47 | 48 | 49 | 50 | 51 | 52 | 53 | 54 | 55 | 56 |
| SEQ ID NO: 16 | W | Y | Q | Q | K | S | D | A | S | P | K | L | W | I | Y | *Y* | *T* | *S* | *N* | *L* | *A* | *P* |
| SEQ ID NO: 26 | W | Y | Q | Q | K | P | G | K | A | P | K | L | L | I | Y | *Y* | *T* | *S* | *N* | *L* | *A* | *P* |
| SEQ ID NO: 27 | W | Y | Q | Q | K | P | G | K | A | P | K | L | L | I | Y | *Y* | *T* | *S* | *N* | *L* | *A* | *P* |
| SEQ ID NO: 28 | W | Y | Q | Q | K | P | G | Q | A | P | R | L | L | I | Y | *Y* | *T* | *S* | *N* | *L* | *A* | *P* |
| SEQ ID NO: 29 | W | Y | Q | Q | L | P | G | T | A | P | K | L | L | I | Y | *Y* | *T* | *S* | *N* | *L* | *A* | *P* |
| SEQ ID NO: 30 | W | Y | Q | Q | K | S | G | Q | A | P | V | L | V | I | Y | *Y* | *T* | *S* | *N* | *L* | *A* | *P* |

| | Framework 3 | | | | | | | | | | | | | | | | | | | | | | | | | | | | | | | |
|---|---|---|---|---|---|---|---|---|---|---|---|---|---|---|---|---|---|---|---|---|---|---|---|---|---|---|---|---|---|---|---|---|
| | 57 | 58 | 59 | 60 | 61 | 62 | 63 | 64 | 65 | 66 | 67 | 68 | 69 | 70 | 71 | 72 | 73 | 74 | 75 | 76 | 77 | 78 | 79 | 80 | 81 | 82 | 83 | 84 | 85 | 86 | 87 | 88 |
| SEQ ID NO: 16 | G | V | P | T | R | F | S | G | S | G | S | G | N | S | Y | S | L | T | I | S | S | M | E | G | E | D | A | A | T | Y | Y | C |
| SEQ ID NO: 26 | G | V | P | S | R | F | S | G | S | G | S | G | N | E | Y | T | L | T | I | S | S | L | Q | P | E | D | F | A | T | Y | Y | C |
| SEQ ID NO: 27 | G | V | P | S | R | F | S | G | S | G | S | G | N | D | Y | T | L | T | I | S | S | L | Q | P | E | D | F | A | T | Y | Y | C |
| SEQ ID NO: 28 | G | I | P | A | R | F | S | G | S | G | S | G | N | E | Y | T | L | T | I | S | S | L | Q | S | E | D | F | A | V | Y | Y | C |
| SEQ ID NO: 29 | G | V | P | D | R | F | S | G | S | G | S | G | N | S | Y | S | L | A | I | S | G | L | R | S | E | D | E | A | D | Y | Y | C |
| SEQ ID NO: 30 | G | I | P | E | R | F | S | G | S | G | S | G | N | M | Y | T | L | T | I | S | G | A | Q | V | E | D | E | A | D | Y | Y | C |

| | CDR 3 | | | | | | | | | Framework 4 | | | | | | | | | |
|---|---|---|---|---|---|---|---|---|---|---|---|---|---|---|---|---|---|---|---|
| | 89 | 90 | 91 | 92 | 93 | 94 | 95 | 96 | 97 | 98 | 99 | 100 | 101 | 102 | 103 | 104 | 105 | 106 | 107 |
| SEQ ID NO: 16 | *Q* | *Q* | *F* | *T* | *S* | *S* | *P* | *F* | *T* | F | G | S | G | T | K | L | E | I | K |
| SEQ ID NO: 26 | *Q* | *Q* | *F* | *T* | *S* | *S* | *P* | *F* | *T* | F | G | Q | G | T | K | L | E | I | K |
| SEQ ID NO: 27 | *Q* | *Q* | *F* | *T* | *S* | *S* | *P* | *F* | *T* | F | G | Q | G | T | K | L | E | I | K |
| SEQ ID NO: 28 | *Q* | *Q* | *F* | *T* | *S* | *S* | *P* | *F* | *T* | F | G | Q | G | T | K | L | E | I | K |
| SEQ ID NO: 29 | *Q* | *Q* | *F* | *T* | *S* | *S* | *P* | *F* | *T* | F | G | T | G | T | K | V | T | V | L |
| SEQ ID NO: 30 | *Q* | *Q* | *F* | *T* | *S* | *S* | *P* | *F* | *T* | F | G | T | G | T | K | V | T | V | L |

FIG. 5B

ELISA data showing direct binding of anti-TRBC1 mAbs (bivalent) to hTRBC1 coated on the plate Octet data showing binding of anti-TRBC1 Fabs to hTRBC1. hTRBC1 was captured on the sensor tip and dipped in solution containing different concentrations of monovalent Fabs

NKp30 $IC_{50}$

| mAb clone: | Human | Cyno | Rat |
|---|---|---|---|
| 9D9-1C1 | 0.89 nM | 0.89 nM | 0.32 nM |
| 16F2-2F3 | 0.51 nM | 0.46 nM | 0.72 nM |
| 16G3-1E5 | 0.44 nM | 0.38 nM | 0.74 nM |

FIG. 14A
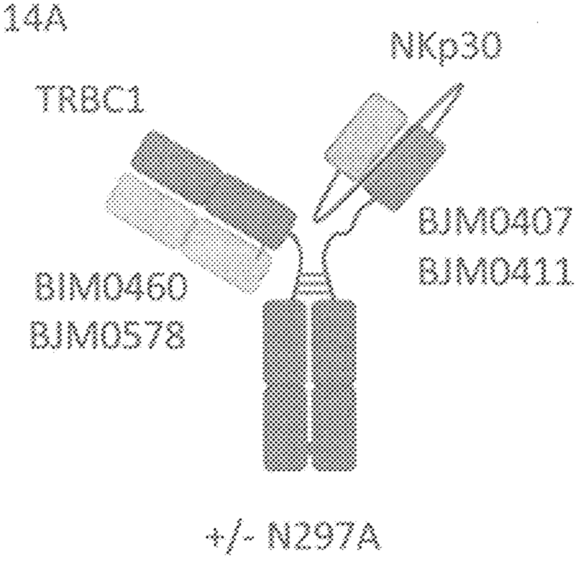
FIG. 14B
BJM1048 460/407 N297A
BJM1051 460/407
BJM1052 460/411 N297A
BJM1053 460/411
BJM1032 578/407
BJM1034 578/411
BJM1038 578/407 N297A
BJM1042 578/411 N297A
FIG. 14C
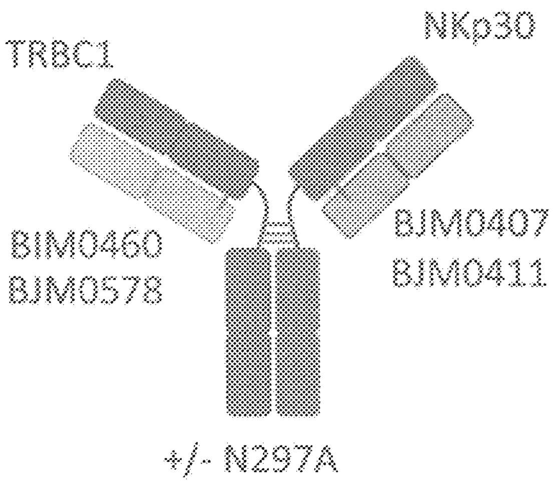
FIG. 14D
BJM0862 460/407
BJM0863 460/411
BJM1028 578/407 N297A
BJM1046 578/411 N297A

| | BJM1048 | BJM1051 | BJM1052 | BJM1053 | BJM1032 | BJM1034 | BJM1038 | BJM1042 | BJM1077 |
|---|---|---|---|---|---|---|---|---|---|
| EC50 | 7.656 | 8.051 | 6.608 | 7.564 | 7.494 | 7.064 | 7.989 | 9.484 | 4.947 |

| | BJM1048 | BJM1051 | BJM1052 | BJM1053 | BJM1032 | BJM1034 | BJM1038 | BJM1042 | BJM0888 |
|---|---|---|---|---|---|---|---|---|---|
| EC50 | 8.288 | 9.545 | 4.554 | 8.271 | 70.99 | 59.80 | 60.48 | 61.01 | 4.971 |

FIG. 15C

| | |
|---|---|
| BJM1048 | Nkp30/TRBC1 bispecific 407/460_N297A |
| BJM1051 | Nkp30/TRBC1 bispecific 407/460_WT |
| BJM1052 | Nkp30/TRBC1 bispecific 411/460_N297A |
| BJM1053 | Nkp30/TRBC1 bispecific 411/460_WT |
| BJM1032 | Nkp30/TRBC1 bispecific 407/578_WT |
| BJM1034 | Nkp30/TRBC1 bispecific 411/578_WT |
| BJM1038 | Nkp30/TRBC1 bispecific 407/578_N297A |
| BJM1042 | Nkp30/TRBC1 bispecific 411/578_N297A |
| BJM1077 | Nkp30 single arm control 411 N297A |
| BJM1078 | Nkp30 single arm control 407 WT |
| BJM1079 | Nkp30 single arm control 411 WT |
| BJM0888 | TRBC1 single arm WT 460 |
| BJM0889 | TRBC1 single arm N297A 460 |
| BJM1084 | TRBC1 578 Single arm control WT |
| BJM1083 | TRBC1 578 Single arm control N297A knob |

FIG. 15D

| | gMFI | |
|---|---|---|
| Sample | EC50 KHYG-1 (NKp30) (nM) | EC50 Jurkat (TRBC1) (nM) |
| BJM1048 | 7.656 | 8.288 |
| BJM1051 | 8.051 | 9.545 |
| BJM1052 | 6.608 | 4.554 |
| BJM1053 | 7.664 | 8.271 |
| BJM1032 | 7.494 | 70.99 |
| BJM1034 | 7.064 | 59.6 |
| BJM1038 | 7.989 | 60.48 |
| BJM1042 | 9.484 | 61.01 |
| BJM1077 | 4.947 | |
| BJM1078 | 5.2 | |
| BJM1079 | 5.357 | |
| BJM0888 | | 4.971 |
| BJM0889 | | 5.261 |
| BJM1084 | | 40.33 |
| BJM1083 | | 44.16 |

| Jurkat | BJM1052 | BJM1042 |
| --- | --- | --- |
| $EC_{50}$ | 0.3976 | 0.3838 |

BJM1052: NKp30xTRBC1(460)
BJM1042: NKp30xTRBC1(578)
BJM0889: TRBC1 (460, N297A)
BJM1077: NKp30 (N297A)
BJM1083:TRBC1 (578, N297A)

| H9 | BJM1052 | BJM1042 |
| --- | --- | --- |
| $EC_{50}$ | 0.4775 | 0.9082 |

| | BJM1052 | BJM1042 |
|---|---|---|
| EC50 | 0.064 | 0.1778 |

BJM1052: NKp30xTRBC1(460)
BJM1042: NKp30xTRBC1(578)
BJM0889: TRBC1 (460, N297A)
BJM1077: NKp30 (N297A)
BJM1083:TRBC1 (578, N297A)

| | BJM1052 | BJM1042 |
|---|---|---|
| EC50 | 0.075 | 0.238 |

BJM0145

BJM0773

| | αNKp30 | αNKp46 | BJM1042 |
|---|---|---|---|
| IC50 | 21.24 | ~ 278.7 | 29.41 |

| SN | Molecule | N | Dose (mg/kg) | Schedule | 1e6 primary NK cells |
|---|---|---|---|---|---|
| 1 | Vehicle | 5 | NA | qd | - |
| 2 | **BJM1042** (NKp30/TRBC1 411/578_N297A) | 5 | 1 | qd | - |
| 3 | Vehicle | 5 | NA | qd | + |
| 4 | **BJM1042** (NKp30/TRBC1 411/578_N297A) | 5 | 1 | qd | + |
| 5 | **BJM1083** (TRBC1 single arm 578 N297A) | 5 | 1 | qd | + |
| 6 | **BJM1077** (NKp30 single arm 411 N297A) | 5 | 1 | qd | + |

| SN | Cell line | NK cells | n | Strain | Treatment | Schedule | Dose |
|---|---|---|---|---|---|---|---|
| 1 | 5e6 HPB-ALL SC | 2e6 IV | 4 | NOG-IL-15 | PBS | Q3D x 2 | NA |
| 2 | 5e6 HPB-ALL SC | 2e6 IV | 5 | NOG-IL-15 | BJM1042 | Q3D x 2 | 0.5mg/kg |
| 3 | 5e6 HPB-ALL SC | 2e6 IV | 4 | NOG-IL-15 | BJM1083 | Q3D x 2 | 0.5mg/kg |
| 4 | 5e6 HPB-ALL SC | 2e6 IV | 4 | NOG-IL-15 | BJM1077 | Q3D x 2 | 0.5mg/kg |

| | aNKp30xTRBC2 (0311) | aNKp30xTRBC2 (0312) |
|---|---|---|
| EC50 | 0.09821 | 0.2324 |

| | aNKp30xTRBC2 (0311) | aNKp30xTRBC2 (0312) |
|---|---|---|
| EC50 | 0.3570 | 0.4469 |

| | aNKp30xTRBC2 (0311) | aNKp30xTRBC2 (0312) |
|---|---|---|
| EC50 | 0.4397 | 0.5176 |

| | aNKp30xTRBC2 (0311) | aNKp30xTRBC2 (0312) |
|---|---|---|
| EC50 | 0.9083 | 1.196 |

| | aNKp30xTRBC2 (0311) | aNKp30xTRBC2 (0312) |
|---|---|---|
| EC50 | 0.1592 | 0.1335 |

| | aNKp30xTRBC1(1042) |
|---|---|
| EC50 | 0.9346 |

MULTIFUNCTIONAL MOLECULES THAT BIND TO T CELL RELATED CANCER CELLS AND USES THEREOF

CROSS-REFERENCE

This application is a continuation of International Application No. PCT/US2021/028970, filed Apr. 23, 2021, which claims the benefit of U.S. Provisional Application No. 63/014,920, filed on Apr. 24, 2020, and U.S. Provisional Application No. 63/070,777, filed on Aug. 26, 2020, each of which is incorporated herein by reference in its entirety.

SEQUENCE LISTING

The instant application contains a Sequence Listing which has been submitted electronically in XML file format and is hereby incorporated by reference in its entirety. Said XML copy, created on Oct. 7, 2022, is named 53676-739_301_SL.xml and is 2,738,324 bytes in size.

BACKGROUND

Lymphomas are cancers that arise from lymphocytes. T cell lymphoma (TCL) is a lymphoma that arises from T cells; these account for approximately 7% of all non-Hodgkin's lymphomas in the United States. Common subtypes of TCL include: Peripheral T Cell Lymphoma, Not Otherwise Specified (PTCLNOS), Anaplastic Large Cell Lymphoma (ALCL), Angioimmunoblastic T Cell Lymphoma (AITL), and Cutaneous T Cell Lymphoma (CTCL). Each type of TCL has its own pathology and symptoms. Given the ongoing need for improved treatment of lymphomas such as TCLs, new compositions and treatments targeting lymphomas, e.g., TCLs, are highly desirable.

SUMMARY

The disclosure relates, inter alia, to novel molecules such as specific antigen binders, such as multispecific or multifunctional molecules, or antibodies that include (i) an antigen binding domain that binds to a tumor antigen on a lymphoma cell (e.g., a T cell), e.g., a T cell receptor comprising T cell receptor beta chain constant domain 1 (TRBC1) or a T cell receptor comprising T cell receptor beta chain constant domain 2 (TRBC2); and one, two or all of: (ii) an immune cell engager (e.g., chosen from an NK cell engager, a T cell engager, a B cell engager, a dendritic cell engager, or a macrophage cell engager); (iii) a cytokine molecule; and/or (iv) a stromal modifying moiety. The terms "multispecific" or "multifunctional" are used interchangeably herein.

Without wishing to be bound by theory, the multispecific or multifunctional molecules disclosed herein are expected to target (e.g., localize, bridge and/or activate) an immune cell (e.g., an immune effector cell chosen from an NK cell, a T cell, a B cell, a dendritic cell or a macrophage), at a target cell, e.g., a cancer cell (e.g., a lymphoma cell), expressing a T cell receptor comprising TRBC1 or TRBC2, and/or alter the tumor stroma, e.g., alter the tumor microenvironment near the cancer site. Increasing the proximity and/or activity of the immune cell using the multispecific molecules described herein is expected to enhance an immune response against the target cell (e.g., the cancer cell, e.g., lymphoma cell), thereby providing a more effective therapy (e.g., a more effective cancer therapy). Without being bound by theory, a targeted, localized immune response against the target cell (e.g., the cancer cell) is believed to reduce the effects of systemic toxicity of the multispecific molecules described herein. Furthermore, in the case where the target cancer cell is a T cell (e.g., a T cell expressing a T cell receptor comprising TRBC1 or TRBC2), a targeted immune response against the cancerous T cell population that targets non-cancerous T cells to a lesser degree (e.g., does not target non-cancerous T cells) is believed to have fewer deleterious effects than systemic ablation of all T cells.

Without wishing to be bound by theory, clonally derived T cell lymphomas and several its premalignant conditions are predominantly positive for either TRBC1 or TRBC2, but not both. In the case of TRBC1+ T cell malignancies, an anti-TRBC1 molecule disclosed herein (e.g., a multifunctional molecule that binds to TRBC1 and NKp30) may deplete TRBC1+ cells while sparing TRBC2+ non-malignant T cells. Similarly, in the case of TRBC2+ T cell malignancies, an anti-TRBC2 molecule disclosed herein (e.g., a multifunctional molecule that binds to TRBC2 and NKp30) may deplete TRBC2+ cells while sparing TRBC1+ non-malignant T cells.

Without wising to be bound by theory, in some embodiments, a multifunctional molecule disclosed herein (e.g., anti-TRBC1/NKp30 antibody) only activates NK cells in the presence of a TRBC1-expressing cell. Without wising to be bound by theory, in some embodiments, a multifunctional molecule disclosed herein (e.g., anti-TRBC2/NKp30 antibody) only activates NK cells in the presence of a TRBC2-expressing cell.

Accordingly, provided herein are, inter alia, multispecific molecules (e.g., multispecific or multifunctional antibody molecules) that include the aforesaid moieties, nucleic acids encoding the same, methods of producing the aforesaid molecules, and methods of treating a cancer using the aforesaid molecules.

In one aspect, provided herein is a multifunctional molecule comprising (i) a first antigen binding domain that binds to T cell receptor beta chain constant domain 1 (TRBC1) or T cell receptor beta chain constant domain 2 (TRBC2), and (ii) a second antigen binding domain that binds to NKp30.

Disclosed herein is a multi-specific molecule, comprising an anti-TRBC2 Fab-Fc knob chain, having a light chain of SEQ ID NO: 8281, a heavy chain sequence of SEQ ID NO: 8283; and an anti-NKp30 scFv-Fc hole chain of SEQ ID NO: 8286. In some embodiments, the multispecific molecule may comprise a sequence that is at least 80% identical to any one of the sequences of SEQ ID NO:8281, SEQ ID NO: 8283; or SEQ ID NO: 8286. In some embodiments, the multispecific molecule may comprise a sequence that is at least 90% identical to any one of the sequences of SEQ ID NO:8281, SEQ ID NO: 8283; or SEQ ID NO: 8286. In some embodiments, the multispecific molecule may comprise a sequence that is at least 95% identical to any one of the sequences of SEQ ID NO:8281, SEQ ID NO: 8283; or SEQ ID NO: 8286.

Disclosed herein is a multi-specific molecule, comprising an anti-TRBC2 Fab-Fc knob chain, having a light chain of SEQ ID NO: 8292, a heavy chain sequence of SEQ ID NO: 8294; and an anti-NKp30 scFv-Fc hole chain of SEQ ID NO: 8286. In some embodiments, the multispecific molecule may comprise a sequence that is at least 80% identical to any one of the sequences of SEQ ID NO:8292, SEQ ID NO: 8294; or SEQ ID NO: 8286. In some embodiments, the multispecific molecule may comprise a sequence that is at least 90% identical to any one of the sequences of SEQ ID NO:8292, SEQ ID NO: 8294; or SEQ ID NO: 8286. In some embodiments, the multispecific molecule may comprise a sequence that is at least 95% identical to any one of the sequences of SEQ ID NO:8292, SEQ ID NO: 8294; or SEQ ID NO: 8286.

Disclosed herein is a TRBC2 binding molecule, comprising an anti-TRBC2 Fab-Fc knob chain, having a light chain of SEQ ID NO: 8297, a heavy chain sequence of SEQ ID NO: 8298; and/or an Fc hole chain of SEQ ID NO: 8300. In some embodiments, the TRBC2 binding molecule may comprise a sequence that is at least 80% identical to any one of the sequences of SEQ ID NO:8297, SEQ ID NO: 8298; or SEQ ID NO: 8300. In some embodiments, the TRBC2 binding molecule may comprise a sequence that is at least 90% identical to any one of the sequences of SEQ ID NO:8297, SEQ ID NO: 8298; or SEQ ID NO: 8300. In some embodiments, the TRBC2 binding molecule may comprise a sequence that is at least 95% identical to any one of the sequences of SEQ ID NO:8297, SEQ ID NO: 8298; or SEQ ID NO: 8300. In some embodiments, the TRBC2 binding molecule comprises an anti-TRBC2 Fab-Fc knob chain, having a light chain sequence that is at least 80% identical to the sequence of SEQ ID NO: 8297, and/or a heavy chain sequence that is at least 80% identical to the sequence of SEQ ID NO: 8298; and/or an Fc hole chain that is at least 80% identical to the sequence of SEQ ID NO: 8300. In some embodiments, the TRBC2 binding molecule comprises an anti-TRBC2 Fab-Fc knob chain, having a light chain sequence that is at least 90% identical to the sequence of SEQ ID NO: 8297, and/or a heavy chain sequence that is at least 90% identical to the sequence of SEQ ID NO: 8298; and/or an Fc hole chain that is at least 90% identical to the sequence of SEQ ID NO: 8300.

Disclosed herein is a TRBC2 binding molecule, comprising an anti-TRBC2 Fab-Fc knob chain, having a light chain of SEQ ID NO: 8301, a heavy chain sequence of SEQ ID NO: 8302; and/or an Fc hole chain of SEQ ID NO: 8300. In some embodiments, the TRBC2 binding molecule may comprise a sequence that is at least 80% identical to any one of the sequences of SEQ ID NO:8301, SEQ ID NO: 8302; and/or SEQ ID NO: 8300. In some embodiments, the TRBC2 binding molecule may comprise a sequence that is at least 90% identical to any one of the sequences of SEQ ID NO:8301, SEQ ID NO: 8302; and/or SEQ ID NO: 8300. In some embodiments, the TRBC2 binding molecule may comprise a sequence that is at least 95% identical to any one of the sequences of SEQ ID NO:8301, SEQ ID NO: 8302; or SEQ ID NO: 8300. In some embodiments, the TRBC2 binding molecule comprises an anti-TRBC2 Fab-Fc knob chain, having a light chain sequence that is at least 80% identical to the sequence of SEQ ID NO: 8301, and/or a heavy chain sequence that is at least 80% identical to the sequence of SEQ ID NO: 8302; and/or an Fc hole chain that is at least 80% identical to the sequence of SEQ ID NO: 8300. In some embodiments, the TRBC2 binding molecule comprises an anti-TRBC2 Fab-Fc knob chain, having a light chain sequence that is at least 90% identical to the sequence of SEQ ID NO: 8301, and/or a heavy chain sequence that is at least 90% identical to the sequence of SEQ ID NO: 8302; and/or an Fc hole chain that is at least 90% identical to the sequence of SEQ ID NO: 8300.

Disclosed herein is a multi-specific molecule, comprising an anti-TRBC1 Fab-Fc knob chain, having a light chain of SEQ ID NO: 7380, a heavy chain sequence of SEQ ID NO: 7382; and an NKp30 scFv-Fc hole chain of SEQ ID NO: 8286. In some embodiments, the multi-specific molecule comprises an anti-TRBC1 Fab-Fc knob chain, having a light chain that is at least 80% identical to the sequence of SEQ ID NO: 7380, and/or a heavy chain that is at least 80% identical to the sequence of SEQ ID NO: 7382; and/or an NKp30 scFv-Fc hole chain that is at least 80% identical to the sequence of SEQ ID NO: 8286. In some embodiments, the multi-specific molecule comprises an anti-TRBC1 Fab-Fc knob chain, having a light chain that is at least 90% identical to the sequence of SEQ ID NO: 7380, and/or a heavy chain that is at least 90% identical to the sequence of SEQ ID NO: 7382; and/or an NKp30 scFv-Fc hole chain that is at least 90% identical to the sequence of SEQ ID NO: 8286.

Disclosed herein is an NK-p30 binding molecule, comprising an anti-NKp30 Fab-Fc knob chain, having a light chain of SEQ ID NO: 8301, a heavy chain sequence of SEQ ID NO: 8302; and/or an Fc hole chain of SEQ ID NO: 8300. In some embodiments, the NK-p30 binding molecule comprises an anti-NKp30 Fab-Fc knob chain, having a light chain of at least 90% sequence identity to SEQ ID NO: 8301, and/or a heavy chain sequence of at least 90% sequence identity to SEQ ID NO: 8302; and/or an Fc hole chain of at least 90% sequence identity to SEQ ID NO: 8300.

Disclosed herein is a TRBC1 binding molecule, comprising an anti-TRBC1 Fab-Fc knob chain, having a light chain of SEQ ID NO: 8307, a heavy chain sequence of SEQ ID NO: 8309; and/or an Fc hole chain of SEQ ID NO: 8300. In some embodiments, the TRBC1 binding molecule comprises an anti-TRBC1 Fab-Fc knob chain, having a light chain of at least 90% sequence identity to SEQ ID NO: 8307, and/or a heavy chain sequence of at least 90% sequence identity to SEQ ID NO: 8309; and/or an Fc hole chain of at least 90% sequence identity to SEQ ID NO: 8300.

In some embodiments, the first antigen binding domain binds to TRBC2. In some embodiments, the first antigen binding domain comprises one or more CDRs, framework regions, variable regions, or antigen binding domains disclosed in any of Tables, Table 9A or Table 9B, Table 10, Table 11, Table 12, Table 13, Table 14, table 15, Table 17, Table 39 or a sequence having at least 85%, 90%, 95%, or 99% identity thereto. In some embodiments, the first antigen binding domain comprises a VH comprising a heavy chain complementarity determining region 1 (VHCDR1), a VHCDR2, and a VHCDR3, and a VL comprising a light chain complementarity determining region 1 (VLCDR1), a VLCDR2, and a VLCDR3. In some embodiments, the VHCDR1, VHCDR2, and VHCDR3 comprise the amino acid sequences of SEQ ID NOs: 7441, 201, and 7442, respectively. In some embodiments, the VLCDR1, VLCDR2, and VLCDR3 comprise the amino acid sequences of SEQ ID NOs: 7443, 224, and 225, respectively. In some embodiments, the VHCDR1, VHCDR2, VHCDR3, VLCDR1, VLCDR2, and VLCDR3 comprise the amino acid sequences of SEQ ID NOs: 7441, 201, 7442, 7443, 224, and 225, respectively. In some embodiments, VHCDR1, VHCDR2, and VHCDR3 comprise the amino acid sequences of: SEQ ID NOs: 7422, 201, and 7403, respectively; SEQ ID NOs: 7401, 201, and 7403, respectively; SEQ ID NOs: 7394, 201, and 7396, respectively; SEQ ID NOs: 7346, 201, and 7398, respectively; SEQ ID NOs: 7346, 201, and 7400, respectively; SEQ ID NOs: 7405, 201, and 7403, respectively; SEQ ID NOs: 7407, 201, and 7403, respectively; SEQ ID NOs: 7427, 201, and 7403, respectively; or SEQ ID NOs: 7430, 201, and 7403, respectively. In some embodiments, the VLCDR1, VLCDR2, and VLCDR3 comprise the amino acid sequences of: SEQ ID NOs: 7410, 224, and 225, respectively; or SEQ ID NOs: 7409, 224, and 225, respectively. In some embodiments, the VHCDR1, VHCDR2, VHCDR3, VLCDR1, VLCDR2, and VLCDR3 comprise the amino acid sequences of: SEQ ID NOs: 7422, 201, 7403, 7410, 224, and 225, respectively; SEQ ID NOs: 7401, 201, 7403, 7410, 224, and 225, respectively; SEQ ID NOs: 7394, 201, 7396, 7410, 224, and 225, respectively; SEQ ID NOs: 7346, 201, 7398, 7410, 224, and 225, respectively; SEQ ID NOs: 7346, 201, 7400, 7410, 224, and 225, respectively; SEQ ID NOs: 7405, 201, 7403, 7410, 224, and 225, respectively; SEQ ID NOs: 7407, 201, 7403, 7410, 224, and 225, respectively; SEQ ID NOs: 7427, 201, 7403, 7410, 224, and 225, respectively; SEQ ID NOs: 7430, 201, 7403, 7410, 224, and 225, respectively; SEQ ID NOs: 7422, 201, 7403, 7409, 224, and 225, respectively; SEQ ID NOs: 7401, 201, 7403, 7409, 224, and 225, respectively; SEQ ID NOs: 7394, 201, 7396, 7409, 224, and 225, respectively; SEQ ID NOs: 7346, 201, 7398, 7409, 224, and 225, respectively; SEQ ID NOs: 7346, 201, 7400, 7409, 224, and 225, respectively; SEQ ID NOs: 7405, 201, 7403, 7409, 224, and 225, respectively; SEQ ID NOs: 7407, 201, 7403, 7409, 224, and 225, respectively; SEQ ID NOs: 7427, 201, 7403, 7409, 224, and 225, respectively; or SEQ ID NOs: 7430, 201, 7403, 7409, 224, and 225, respectively. In some embodiments, the VH comprises an amino acid sequence selected from the group consisting of SEQ ID NOs: 7420, 7423, 7411, 7412, 7413, 7414, 7415, 7416, 7417, 7425, 7428, and 7431 (or a sequence having at least 85%, 90%, 95%, or 99% identity thereto). In some embodiments, the VL comprises an amino acid sequence selected from the group consisting of SEQ ID NOs: 7419 and 7418 (or a sequence having at least 85%, 90%, 95%, or 99% identity thereto). In some embodiments, the VH and VL comprise the amino acid sequences of: SEQ ID NOs: 7420 and 7419, respectively (or a sequence having at least 85%, 90%, 95%, or 99% identity thereto); SEQ ID NOs: 7423 and 7419, respectively (or a sequence having at least 85%, 90%, 95%, or 99% identity thereto); SEQ ID NOs: 7411 and 7419, respectively (or a sequence having at least 85%, 90%, 95%, or 99% identity thereto); SEQ ID NOs: 7412 and 7419, respectively (or a sequence having at least 85%, 90%, 95%, or 99% identity thereto); SEQ ID NOs: 7413 and 7419, respectively (or a sequence having at least 85%, 90%, 95%, or 99% identity thereto); SEQ ID NOs: 7414 and 7419, respectively (or a sequence having at least 85%, 90%, 95%, or 99% identity thereto); SEQ ID NOs: 7415 and 7419, respectively (or a sequence having at least 85%, 90%, 95%, or 99% identity thereto); SEQ ID NOs: 7416 and 7419, respectively (or a sequence having at least 85%, 90%, 95%, or 99% identity thereto); SEQ ID NOs: 7417 and 7419, respectively (or a sequence having at least 85%, 90%, 95%, or 99% identity thereto); SEQ ID NOs: 7425 and 7419, respectively (or a sequence having at least 85%, 90%, 95%, or 99% identity thereto); SEQ ID NOs: 7428 and 7419, respectively (or a sequence having at least 85%, 90%, 95%, or 99% identity thereto); SEQ ID NOs: 7431 and 7419, respectively (or a sequence having at least 85%, 90%, 95%, or 99% identity thereto); SEQ ID NOs: 7420 and 7418, respectively (or a sequence having at least 85%, 90%, 95%, or 99% identity thereto); SEQ ID NOs: 7423 and 7418, respectively (or a sequence having at least 85%, 90%, 95%, or 99% identity thereto); SEQ ID NOs: 7411 and 7418, respectively (or a sequence having at least 85%, 90%, 95%, or 99% identity thereto); SEQ ID NOs: 7412 and 7418, respectively (or a sequence having at least 85%, 90%, 95%, or 99% identity thereto); SEQ ID NOs: 7413 and 7418, respectively (or a sequence having at least 85%, 90%, 95%, or 99% identity thereto); SEQ ID NOs: 7414 and 7418, respectively (or a sequence having at least 85%, 90%, 95%, or 99% identity thereto); SEQ ID NOs: 7415 and 7418, respectively (or a sequence having at least 85%, 90%, 95%, or 99% identity thereto); SEQ ID NOs: 7416 and 7418, respectively (or a sequence having at least 85%, 90%, 95%, or 99% identity thereto); SEQ ID NOs: 7417 and 7418, respectively (or a sequence having at least 85%, 90%, 95%, or 99% identity thereto); SEQ ID NOs: 7425 and 7418, respectively (or a sequence having at least 85%, 90%, 95%, or 99% identity thereto); SEQ ID NOs: 7428 and 7418, respectively (or a sequence having at least 85%, 90%, 95%, or 99% identity thereto); SEQ ID NOs: 7431 and 7418, respectively (or a sequence having at least 85%, 90%, 95%, or 99% identity thereto).

In some embodiments, the first antigen binding domain has a higher affinity for a T cell receptor comprising TRBC2 than for a T cell receptor not comprising TRBC2, optionally wherein the KD for the binding between the first antigen binding domain and TRBC2 is no more than 40%, 30%, 20%, 10%, 1%, 0.1%, or 0.01% of the KD for the binding between the first antigen binding domain and a T cell receptor not comprising TRBC2. In some embodiments, the first antigen binding domain has a higher affinity for a T cell receptor comprising TRBC2 than for a T cell receptor comprising TRBC1, optionally wherein the $K_D$ for the binding between the first antigen binding domain and TRBC2 is no more than 40%, 30%, 20%, 10%, 1%, 0.10%, or 0.010% of the $K_D$ for the binding between the first antigen binding domain and a T cell receptor comprising TRBC1. In some embodiments, binding of the first antigen binding domain to TRBC2 on a lymphoma cell or lymphocyte, e.g., T cell, does not appreciably activate the lymphoma cell or lymphocyte, e.g., T cell, e.g., as measured by T cell proliferation, expression of a T cell activation marker (e.g., CD69 or CD25), and/or expression of a cytokine (e.g., TNFα and IFNγ). In some embodiments, the multifunctional molecule does not activate NK cells or does not substantially activate NK cells in the absence of a TRBC2-expressing cell.

In some embodiments, the first antigen binding domain binds to TRBC1. In some embodiments, the first antigen binding domain comprises one or more CDRs, framework regions, variable regions, or antigen binding domains disclosed in any of Table 1, Table 2A or 2B, Table 3A or Table 3B, Table 4, Table 7, Table 8 and Table 16, or a sequence having at least 85%, 90%, 95%, or 99% identity thereto. In some embodiments, the first antigen binding domain comprises a VH comprising a heavy chain complementarity determining region 1 (VHCDR1), a VHCDR2, and a VHCDR3, and a VL comprising a light chain complementarity determining region 1 (VLCDR1), a VLCDR2, and a VLCDR3, wherein the VHCDR1, VHCDR2, and VHCDR3 comprise the amino acid sequences of: SEQ ID NOs: 7346, 7355, and 202, respectively; SEQ ID NOs: 7346, 201, and 202, respectively; SEQ ID NOs: 7354, 201, and 202, respectively; or SEQ ID NOs: 7354, 7355, and 202, respectively. In some embodiments, the VLCDR1, VLCDR2, and VLCDR3 comprise the amino acid sequences of: SEQ ID NOs: 223, 224, and 225, respectively; SEQ ID NOs: 7367, 224, and 225, respectively; SEQ ID NOs: 223, 7368, and 225, respectively; SEQ ID NOs: 223, 224, and 7369, respectively; or SEQ ID NOs: 7367, 7368, and 7369, respectively. In some embodiments, the VHCDR1, VHCDR2, VHCDR3, VLCDR1, VLCDR2, and VLCDR3 comprise the amino acid sequences of: SEQ ID NOs: 7346, 7355, 202, 223, 224, and 225, respectively; SEQ ID NOs: 7346, 201, 202, 223, 224, and 225, respectively; SEQ ID NOs: 7346, 7355, 202, 7367, 224, and 225, respectively; SEQ ID NOs: 7346, 7355, 202, 223, 7368, and 225, respectively; SEQ ID NOs: 7346, 7355, 202, 223, 224, and 7369, respectively; SEQ ID NOs:

7346, 7355, 202, 7367, 7368, and 7369, respectively; SEQ ID NOs: 7346, 201, 202, 7367, 224, and 225, respectively; SEQ ID NOs: 7346, 201, 202, 223, 7368, and 225, respectively; SEQ ID NOs: 7346, 201, 202, 223, 224, and 7369, respectively; SEQ ID NOs: 7346, 201, 202, 7367, 7368, and 7369, respectively; SEQ ID NOs: 7354, 201, 202, 223, 224, and 225, respectively; SEQ ID NOs: 7354, 201, 202, 7367, 224, and 225, respectively; SEQ ID NOs: 7354, 201, 202, 223, 7368, and 225, respectively; SEQ ID NOs: 7354, 201, 202, 223, 224, and 7369, respectively; SEQ ID NOs: 7354, 201, 202, 7367, 7368, and 7369, respectively; SEQ ID NOs: 7354, 7355, 202, 223, 224, and 225, respectively; SEQ ID NOs: 7354, 7355, 202, 7367, 224, and 225, respectively; SEQ ID NOs: 7354, 7355, 202, 223, 7368, and 225, respectively; SEQ ID NOs: 7354, 7355, 202, 223, 224, and 7369, respectively; or SEQ ID NOs: 7354, 7355, 202, 7367, 7368, and 7369, respectively. In some embodiments, the VH comprises an amino acid sequence selected from the group consisting of SEQ ID NOs: 7351, 253, 250-252, 254, 7343, 7344, 7350, and 7352 (or a sequence having at least 85%, 90%, 95%, or 99% identity thereto) and/or the VL comprises an amino acid sequence selected from the group consisting of SEQ ID NOs: 258, 255-257, 259, 260, and 7357-7360 (or a sequence having at least 85%, 90%, 95%, or 99% identity thereto). In some embodiments, the VH and VL comprise the amino acid sequences of: SEQ ID NOs: 7351 and 258, respectively (or a sequence having at least 85%, 90%, 95%, or 99% identity thereto); or SEQ ID NOs: 253 and 258, respectively (or a sequence having at least 85%, 90%, 95%, or 99% identity thereto).

In some embodiments, the first antigen binding domain has a higher affinity for a T cell receptor comprising TRBC1 than for T cell receptors not comprising TRBC1, optionally wherein the KD for the binding between the first antigen binding domain and TRBC1 is no more than 40%, 30%, 20%, 10%, 1%, 0.1%, or 0.01% of the KD for the binding between the first antigen binding domain and a T cell receptor not comprising TRBC1. In some embodiments, the first antigen binding domain has a higher affinity for a T cell receptor comprising TRBC1 than for T cell receptors comprising TRBC2, optionally wherein the $K_D$ for the binding between the first antigen binding domain and TRBC1 is no more than 40%, 30%, 20%, 10%, 1%, 0.1%, or 0.01% of the $K_D$ for the binding between the first antigen binding domain and a T cell receptor comprising TRBC2. In some embodiments, binding of the first antigen binding domain to TRBC1 on a lymphoma cell or lymphocyte, e.g., T cell, does not appreciably activate the lymphoma cell or lymphocyte, e.g., T cell, (e.g., as measured by T cell proliferation, expression of a T cell activation marker (e.g., CD69 or CD25), and/or expression of a cytokine (e.g., TNFα and IFNγ). In some embodiments, the multifunctional molecule does not activate NK cells or does not substantially activate NK cells in the absence of a TRBC1-expressing cell.

In some embodiments, the second antigen binding domain comprises one or more CDRs, framework regions, variable regions, or antigen binding domains disclosed in any of Tables, Table 16, Table 17, Table 20A or Table 20B, Table 21A or Table 21B, Table 22, Table 23A or Table 23B, Table 24, Table 25, and Table 26, or a sequence having at least 85%, 90%, 95%, or 99% identity thereto. In some embodiments, the second antigen binding domain comprises a VH comprising a heavy chain complementarity determining region 1 (VHCDR1), a VHCDR2, and a VHCDR3, and a VL comprising a light chain complementarity determining region 1 (VLCDR1), a VLCDR2, and a VLCDR3, wherein the VHCDR1, VHCDR2, and VHCDR3 of the second antigen binding domain comprise the amino acid sequences of: SEQ ID NOs: 7313, 6001, and 7315, respectively; SEQ ID NOs: 7313, 6001, and 6002, respectively; SEQ ID NOs: 7313, 6008, and 6009, respectively; SEQ ID NOs: 7313, 7385, and 7315, respectively; or SEQ ID NOs: 7313, 7318, and 6009, respectively, SEQ ID NOs: 7313, 7318, and 6009, respectively; SEQ ID NOs: 8053, 6001, and 7315, respectively; SEQ ID NOs: 8053, 6001, and 7315, respectively; SEQ ID NOs: 8053, 6001, and 7315, respectively; SEQ ID NOs: 8053, 6001, and 7315, respectively; SEQ ID NOs: 8053, 8688, and 7315, respectively; SEQ ID NOs: 8053, 8688, and 7315, respectively; SEQ ID NOs: 8053, 8688, and 7315, respectively; or SEQ ID NOs: 8053, 8688, and 7315, respectively. In some embodiments, the VLCDR1, VLCDR2, and VLCDR3 of the second antigen binding domain comprise the amino acid sequences of: SEQ ID NOs: 7326, 7327, and 7329, respectively; SEQ ID NOs: 6063, 6064, and 7293, respectively; SEQ ID NOs: 6070, 6071, and 6072, respectively; SEQ ID NOs: 6070, 6064, and 7321, respectively; SEQ ID NOs: 7326, 7327, and 8689, respectively; SEQ ID NOs: 7326, 7327, and 8690, respectively; SEQ ID NOs: 7326, 7327, and 8690, respectively; SEQ ID NOs: 7326, 7327, and 8689, respectively; SEQ ID NOs: 7326, 7327, and 7329, respectively; SEQ ID NOs: 7326, 7327, and 7329, respectively; SEQ ID NOs: 7326, 7327, and 8691, respectively; SEQ ID NOs: 7326, 7327, and 8691, respectively. In some embodiments, the VHCDR1, VHCDR2, VHCDR3, VLCDR1, VLCDR2, and VLCDR3 of the second antigen binding domain comprise the amino acid sequences of: SEQ ID NOs: 7313, 6001, 7315, 7326, 7327, and 7329, respectively; SEQ ID NOs: 7313, 6001, 6002, 6063, 6064, and 7293, respectively; SEQ ID NOs: 7313, 6008, 6009, 6070, 6071, and 6072, respectively; SEQ ID NOs: 7313, 7385, 7315, 6070, 6064, and 7321, respectively; SEQ ID NOs: 7313, 7318, 6009, 6070, 6064, and 7321, respectively; SEQ ID NOs: 8053, 6001, 7315, 7326, 7327, and 8689, respectively; SEQ ID NOs: 8053, 6001, 7315, 7326, 7327, and 8690, respectively; SEQ ID NOs: 8053, 6001, 7315, 7326, 7327, and 8690, respectively; SEQ ID NOs: 8053, 6001, 7315, 7326, 7327, and 8689, respectively; SEQ ID NOs: 8053, 8688, 7315, 7326, 7327, and 7329, respectively; SEQ ID NOs: 8053, 8688, 7315, 7326, 7327, and 7329, respectively; SEQ ID NOs: 8053, 8688, 7315, 7326, 7327, and 8691, respectively; or SEQ ID NOs: 8053, 8688, 7315, 7326, 7327, and 8691, respectively. In some embodiments, the VH of the second antigen binding domain comprises an amino acid sequence selected from the group consisting of SEQ ID NOs: 7302, 7298, 7300, 7301, 7303, and 7304 (or a sequence having at least 85%, 90%, 95%, or 99% identity thereto) and/or the VL of the second antigen binding domain comprises an amino acid sequence selected from the group consisting of SEQ ID NOs: 7309, 7305, 7299, 7306-7308 (or a sequence having at least 85%, 90%, 95%, or 99% identity thereto). In some embodiments, the VH of the second antigen binding domain comprises an amino acid sequence selected from the group consisting of SEQ ID NOs: 6121 or 6123-6128 (or a sequence having at least 85%, 90%, 95%, or 99% identity thereto) and/or the VL of the second antigen binding domain comprises an amino acid sequence selected from the group consisting of SEQ ID NOs: 7294 or 6137-6141 (or a sequence having at least 85%, 90%, 95%, or 99% identity thereto). In some embodiments, the VH of the second antigen binding domain comprises an amino acid sequence selected from the group consisting of SEQ ID NOs: 6122 or 6129-6134 (or a sequence having at least 85%, 90%, 95%, or 99% identity thereto) and/or the VL of the second antigen binding domain comprises an amino acid sequence selected from the group consisting of SEQ ID NOs: 6136 or 6142-6147 (or a sequence having at least 85%, 90%, 95%, or 99% identity thereto). In some embodiments, the VH of the second antigen binding domain comprises an amino acid sequence selected from the group consisting of SEQ ID NOs: 7302 and 8692 (or a sequence having at least 85%, 90%, 95%, or 99% identity thereto); and/or the VL of the second antigen binding domain comprises an amino acid sequence selected from the group consisting of SEQ ID NOs: 8693-8696, 7309, 7305, 8697, and 8698 (or a sequence having at least 85%, 90%, 95%, or 99% identity thereto). In some embodiments, the VH and VL of the second antigen binding domain comprise the amino acid sequences of: SEQ ID NOs: 7302 and 7309, respectively (or a sequence having at least 85%, 90%, 95%, or 99% identity thereto); or SEQ ID NOs: 7302 and 7305, respectively (or a sequence having at least 85%, 90%, 95%, or 99% identity thereto). In some embodiments, the second antigen binding domain comprise the amino acid sequences of: SEQ ID NO: 7311 or 7310 (or a sequence having at least 85%, 90%, 95%, or 99% identity thereto); SEQ ID NO: 6187 or 6188 (or a sequence having at least 85%, 90%, 95%, or 99% identity thereto); or SEQ ID NO: 6189 or 6190 (or a sequence having at least 85%, 90%, 95%, or 99% identity thereto, any of SEQ ID NOs: 8699-8706).

In some embodiments, the multifunctional molecule binds to TRBC2 monovalently. In some embodiments, the multifunctional molecule comprises a configuration shown in any of FIGS. 30A-30D, optionally wherein: (i) the multifunctional antibody molecule comprises an anti-TRBC2 Fab and an anti-NKp30 scFv, e.g., comprises a configuration shown in FIG. 30A; (ii) the multifunctional antibody molecule comprises an anti-TRBC2 Fab and an anti-NKp30 Fab, e.g., comprises a configuration shown in FIG. 30B; (iii) the multifunctional antibody molecule comprises an anti-NKp30 Fab and an anti-TRBC2 scFv, e.g., comprises a configuration shown in FIG. 30C; or (iv) the multifunctional antibody molecule comprises an anti-TRBC2 scFv and an anti-NKp30 scFv, e.g., comprises a configuration shown in FIG. 30D.

In some embodiments, the multifunctional molecule binds to TRBC1 monovalently. In some embodiments, the multifunctional molecule comprises a configuration shown in any of FIGS. 29A-29D, optionally wherein: (i) the multifunctional antibody molecule comprises an anti-TRBC1 Fab and an anti-NKp30 scFv, e.g., comprises a configuration shown in FIG. 29A; (ii) the multifunctional antibody molecule comprises an anti-TRBC1 Fab and an anti-NKp30 Fab, e.g., comprises a configuration shown in FIG. 29B; (iii) the multifunctional antibody molecule comprises an anti-NKp30 Fab and an anti-TRBC1 scFv, e.g., comprises a configuration shown in FIG. 29C; or (iv) the multifunctional antibody molecule comprises an anti-TRBC1 scFv and an anti-NKp30 scFv, e.g., comprises a configuration shown in FIG. 29D.

In some embodiments, a multifunctional molecule disclosed herein further comprises a dimerization module comprising one or more immunoglobulin chain constant regions (e.g., Fc regions) comprising one or more of: a paired cavity-protuberance ("knob-in-a hole"), an electrostatic interaction, or a strand-exchange.

In some embodiments, the multifunctional molecule comprises an anti-TRBC2 amino acid sequence disclosed in any of Table 9A or Table 9B, Table 10, Table 11, Table 12, Table 13, Table 14, table 15, Table 17, Table 39, or a sequence having at least 85%, 90%, 95%, or 99% identity thereto, and/or an anti-NKp30 amino acid sequence disclosed in any of Table 20A or Table 20B, Table 22, Table 23A or Table 23B, Table 24, Table 25, Table 26, Table 21A or Table 21B, and Table 17, or a sequence having at least 85%, 90%, 95%, or 99% identity thereto. In some embodiments, the multifunctional molecule comprises an anti-TRBC2 VH of SEQ ID NO: 7420 (or a sequence having at least 85%, 90%, 95%, or 99% identity thereto), an anti-TRBC2 VL of SEQ ID NO: 7419 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7309 (or a sequence having at least 85%, 90%, 95%, or 99% identity thereto). In some embodiments, the multifunctional molecule comprises an anti-TRBC2 VH of SEQ ID NO: 7420 (or a sequence having at least 85%, 90%, 95%, or 99% identity thereto), an anti-TRBC2 VL of SEQ ID NO: 7419 (or a sequence having at least 85%, 90%, 95%, or 99% identity thereto), and an anti-NKp30 scFv of SEQ ID NO: 7311 (or a sequence having at least 85%, 90%, 95%, or 99% identity thereto). In some embodiments, the multifunctional molecule comprises SEQ ID NOs: 7438, 7439, and 7383 (or a sequence having at least 85%, 90%, 95%, or 99% identity thereto). In some embodiments, the multifunctional molecule comprises an anti-TRBC2 VH of SEQ ID NO: 7423 (or a sequence having at least 85%, 90%, 95%, or 99% identity thereto), an anti-TRBC2 VL of SEQ ID NO: 7419 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7309 (or a sequence having at least 85%, 90%, 95%, or 99% identity thereto). In some embodiments, the multifunctional molecule comprises an anti-TRBC2 VH of SEQ ID NO: 7423 (or a sequence having at least 85%, 90%, 95%, or 99% identity thereto), an anti-TRBC2 VL of SEQ ID NO: 7419 (or a sequence having at least 85%, 90%, 95%, or 99% identity thereto), and an anti-NKp30 scFv of SEQ ID NO: 7311 (or a sequence having at least 85%, 90%, 95%, or 99% identity thereto). In some embodiments, the multifunctional molecule comprises SEQ ID NOs: 7440, 7439, and 7383 (or a sequence having at least 85%, 90%, 95%, or 99% identity thereto).

In some embodiments, the multifunctional molecule comprises an anti-TRBC1 amino acid sequence disclosed in any of Table 1, Table 2A or Table 2B, Table 3A or Table 3B, Table 4, Table 7, Table 8 and Table 16, or a sequence having at least 85%, 90%, 95%, or 99% identity thereto, and/or an anti-NKp30 amino acid sequence disclosed in any of Table 16, Table 17, Table 20A or Table 20B, Table 21A or Table 21B, Table 22, Table 23A or Table 23B, Table 24, Table 25, Table 26, or a sequence having at least 85%, 90%, 95%, or 99% identity thereto. In some embodiments, the multifunctional molecule comprises: (i) an anti-TRBC1 VH of SEQ ID NO: 7351 (or a sequence having at least 85%, 90%, 95%, or 99% identity thereto), an anti-TRBC1 VL of SEQ ID NO: 258 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7309 (or a sequence having at least 85%, 90%, 95%, or 99% identity thereto); (ii) an anti-TRBC1 VH of SEQ ID NO: 7351 (or a sequence having at least 85%, 90%, 95%, or 99% identity thereto), an anti-TRBC1 VL of SEQ ID NO: 258 (or a sequence having at least 85%, 90%, 95%, or 99% identity thereto), and an anti-NKp30 scFv of SEQ ID NO: 7311 (or a sequence having at least 85%, 90%, 95%, or 99% identity thereto); or (iii) SEQ ID NOs: 7382, 7380, and 7383 (or a sequence having at least 85%, 90%, 95%, or 99% identity thereto). In some embodiments, the multifunctional molecule comprises: (i) an anti-TRBC1 VH of SEQ ID NO: 253 (or a sequence having at least 85%, 90%, 95%, or 99% identity thereto), an anti-TRBC1 VL of SEQ ID NO: 258 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7309 (or a sequence having at least 85%, 90%, 95%, or 99% identity thereto); (ii) an anti-TRBC1 VH of SEQ ID NO: 253 (or a sequence having at least 85%, 90%, 95%, or 99% identity thereto), an anti-TRBC1 VL of SEQ ID NO: 258 (or a sequence having at least 85%, 90%, 95%, or 99% identity thereto), and an anti-NKp30 scFv of SEQ ID NO: 7311 (or a sequence having at least 85%, 90%, 95%, or 99% identity thereto); or (iii) SEQ ID NOs: 7379, 7380, and 7383 (or a sequence having at least 85%, 90%, 95%, or 99% identity thereto). In some embodiments, the multifunctional molecule comprises: (i) an anti-TRBC1 VH of SEQ ID NO: 7351 (or a sequence having at least 85%, 90%, 95%, or 99% identity thereto), an anti-TRBC1 VL of SEQ ID NO: 258 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7305 (or a sequence having at least 85%, 90%, 95%, or 99% identity thereto); (ii) an anti-TRBC1 VH of SEQ ID NO: 7351 (or a sequence having at least 85%, 90%, 95%, or 99% identity thereto), an anti-TRBC1 VL of SEQ ID NO: 258 (or a sequence having at least 85%, 90%, 95%, or 99% identity thereto), and an anti-NKp30 scFv of SEQ ID NO: 7310 (or a sequence having at least 85%, 90%, 95%, or 99% identity thereto); or (iii) SEQ ID NOs: 7382, 7380, and 7384 (or a sequence having at least 85%, 90%, 95%, or 99% identity thereto). In some embodiments, the multifunctional molecule comprises: (i) an anti-TRBC1 VH of SEQ ID NO: 253 (or a sequence having at least 85%, 90%, 95%, or 99% identity thereto), an anti-TRBC1 VL of SEQ ID NO: 258 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7305 (or a sequence having at least 85%, 90%, 95%, or 99% identity thereto); (ii) an anti-TRBC1 VH of SEQ ID NO: 253 (or a sequence having at least 85%, 90%, 95%, or 99% identity thereto), an anti-TRBC1 VL of SEQ ID NO: 258 (or a sequence having at least 85%, 90%, 95%, or 99% identity thereto), and an anti-NKp30 scFv of SEQ ID NO: 7310 (or a sequence having at least 85%, 90%, 95%, or 99% identity thereto); or (iii) SEQ ID NOs: 7379, 7380, and 7384 (or a sequence having at least 85%, 90%, 95%, or 99% identity thereto).

In some embodiments, the multifunctional molecule comprises: a heavy chain constant region variant, e.g., an Fc region variant, that comprises one or more mutations that result in reduced or ablated affinity for at least one Fc receptor, optionally wherein the one or more mutations result in reduced or ablated antibody dependent cell-mediated cytotoxicity (ADCC), Antibody-dependent cellular phagocytosis (ADCP), or complement dependent cytotoxicity (CDC). In some embodiments, the Fc region variant comprises one or more mutations disclosed in Table 18, optionally wherein the Fc region variant comprises an N297A mutation.

In an aspect, the disclosure features a multifunctional molecule, comprising: (i) a first antigen binding domain that binds to T cell receptor beta chain constant domain 1 (TRBC1), and (ii) a second antigen binding domain that binds to NKp30, wherein the first antigen binding domain comprises one or more CDRs, framework regions, variable regions, or antigen binding domains disclosed in any of Table 5A or Table 5B, Table 5A or Table 5B, Table 6, or Table 7 (e.g., any of SEQ ID NOs: 200, 202, 208, 210, 215, 217, 224, 225, 232, 233, 238, 239, 7351, 7355, and 8673-8686), or a sequence having at least 85%, 90%, 95%, or 99% identity thereto.

In some embodiments, the second antigen binding domain comprises one or more CDRs, framework regions, variable regions, or antigen binding domains disclosed herein.

In another aspect, the disclosure features a multifunctional molecule, comprising: (i) a first antigen binding domain that binds to T cell receptor beta chain constant domain 1 (TRBC1), and (ii) a second antigen binding domain that binds to NKp30, wherein the second antigen binding domain comprises one or more CDRs, framework regions, variable regions, or antigen binding domains disclosed in any of Tables Table 23A or Table 23B, Table 24, Table 25, or Table 26 (e.g., any of SEQ ID NOs 233, 6001, 6006, 6023, 6024, 6080, 6106, 7302, 7305, 7309, 7315, 7326, 7327, 7329, 7335, 7336, 7340-7342, 8053, and 8687-8706), or Table 21A or Table 21B, or Table 17, or a sequence having at least 85%, 90%, 95%, or 99% identity thereto.

In some embodiments, the first antigen binding domain comprises one or more CDRs, framework regions, variable regions, or antigen binding domains disclosed herein.

In an aspect, the disclosure features a multifunctional molecule, comprising:

(i) a first antigen binding domain that binds to T cell receptor beta chain constant domain 1 (TRBC1), and
(ii) a second antigen binding domain that binds to NKp30,
wherein the first antigen binding domain comprises one or more CDRs, framework regions, variable regions, or antigen binding domains disclosed in any of Table 5A or Table 5B, Table 6, or Table 7 (e.g., any of SEQ ID NOs: 200, 202, 208, 210, 215, 217, 224, 225, 232, 233, 238, 239, 7351, 7355, and 8673-8686), or a sequence having at least 85%, 90%, 95%, or 99% identity thereto; and
wherein the second antigen binding domain comprises one or more CDRs, framework regions, variable regions, or antigen binding domains disclosed in any of Tables 8A, Table 16, Table 17, Table 21A or Table 21B, Table 24, Table 25 or Table 26 (e.g., any of SEQ ID NOs 233, 6001, 6006, 6023, 6024, 6080, 6106, 7302, 7305, 7309, 7315, 7326, 7327, 7329, 7335, 7336, 7340-7342, 8053, and 8687-8706): or a sequence having at least 85%, 90%, 95%, or 99% identity thereto.

In one aspect, provided herein is an antibody molecule that binds to TRBC2, comprising one or more CDRs, framework regions, variable regions, or antigen binding domains disclosed in any of Table 9A or Table 9B, Table 10, Table 11, Table 12, Table 13, Table 14, table 15, Table 17, Table 39, or a sequence having at least 85%, 90%, 95%, or 99% identity thereto. In some embodiments, the antibody molecule that binds to TRBC2 comprises one or more CDRs (e.g., VHCDR1, VHCDR2, VHCDR3, VLCDR1, VLCDR2, and/or VLCDR3) disclosed in Table 9 or Table 10, or a sequence having at least 85%, 90%, 95%, or 99% identity thereto. In some embodiments, the antibody molecule that binds to TRBC2 comprises one or more framework regions (e.g., VHFWR1, VHFWR2, VHFWR3, VHFWR4, VLFWR1, VLFWR2, VLFWR3, and/or VLFWR4) disclosed in Table 9 or Table 10, or a sequence having at least 85%, 90%, 95%, or 99% identity thereto. In some embodiments, the antibody molecule that binds to TRBC2 comprises a VH and/or a VL disclosed in Table 11, or a sequence having at least 85%, 90%, 95%, or 99% identity thereto. In some embodiments, the antibody molecule that binds to TRBC2 comprises an amino acid sequence disclosed in Table 12, or a sequence having at least 85%, 90%, 95%, or 99% identity thereto.

In one aspect, provided herein is an antibody molecule that binds to NKp30, comprising one or more CDRs, framework regions, variable regions, or antigen binding domains disclosed in any of Table 16, Table 17, Table 20A or Table 20B, Table 21A or Table 21B, Table 22, Table 23A or Table 23B, Table 24, Table 25, Table 26 or a sequence having at least 85%, 90%, 95%, or 99% identity thereto.

In one aspect, provided herein is an antibody molecule that binds to TRBC1, comprising one or more CDRs, framework regions, variable regions, or antigen binding domains disclosed in any of Table 1, Table 2A or Table 2B, Table 3A or Table 3B, Table 4, Table 7, Table 8, and Table 16, or a sequence having at least 85%, 90%, 95%, or 99% identity thereto.

In some embodiments, the antibody molecule comprises a heavy chain constant region variant, e.g., an Fc region variant, that comprises one or more mutations that result in reduced or ablated affinity for at least one Fc receptor, optionally wherein the one or more mutations result in reduced or ablated antibody dependent cell-mediated cytotoxicity (ADCC), Antibody-dependent cellular phagocytosis (ADCP), or complement dependent cytotoxicity (CDC). In some embodiments, the Fc region variant comprises one or more mutations disclosed in Table 18, optionally wherein the Fc region variant comprises an N297A mutation.

In some embodiments, an amino acid sequence disclosed herein comprises a signal peptide of METDTLLLWVLLLWVPGSTG (SEQ ID NO: 7444). In some embodiments, an amino acid sequence disclosed herein does not comprise a signal peptide of METDTLLLWVLLLWVPGSTG (SEQ ID NO: 7444)

In one aspect, provide herein is a nucleic acid molecule encoding a multifunctional molecule disclosed herein or an antibody molecule disclosed herein. In one aspect, provide herein is a vector, e.g., an expression vector, comprising a nucleic acid molecule disclosed herein. In one aspect, provide herein is a cell comprising a nucleic acid molecule disclosed herein or a vector disclosed herein. In one aspect, provide herein is a pharmaceutical composition comprising a multifunctional molecule disclosed herein or an antibody molecule disclosed herein and a pharmaceutically acceptable carrier, excipient, or stabilizer.

In one aspect, provide herein is a method of making, e.g., producing, a multifunctional molecule disclosed herein or an antibody molecule disclosed herein, comprising culturing a cell disclosed herein, under suitable conditions, e.g., conditions suitable for gene expression and/or homo- or heterodimerization.

In one aspect, provide herein is a method of treating a cancer, comprising administering to a subject in need thereof a multifunctional molecule disclosed herein or an antibody molecule disclosed herein, wherein the multifunctional molecule or antibody molecule is administered in an amount effective to treat the cancer. In some embodiments, the method further comprises identifying, evaluating, or selecting a subject in need of treatment, wherein identifying, evaluating, or selecting comprises determining (e.g., directly determining or indirectly determining, e.g., obtaining information regarding) whether a subject has cancer cells that express a T cell receptor comprising TRBC1 or TRBC2. In some embodiments, the method further comprises: responsive to a determination that a subject has cancer cells that express a T cell receptor comprising TRBC2: optionally, selecting the subject for treatment with a multifunctional molecule comprising an antigen binding domain that binds to a T cell receptor comprising TRBC2, and administering a multifunctional molecule disclosed herein comprising an antigen binding domain that binds to a T cell receptor comprising TRBC2. In some embodiments, the method further comprises: responsive to a determination that a subject has cancer cells that express a T cell receptor comprising TRBC1: optionally, selecting the subject for treatment with a multifunctional molecule comprising an antigen binding domain that binds to a T cell receptor comprising TRBC1, and administering a multifunctional molecule disclosed herein comprising an antigen binding domain that binds to a T cell receptor comprising TRBC1.

In one aspect, provide herein is a method of treating a cancer, e.g., a lymphoma or leukemia, e.g., a T cell lymphoma or leukemia, comprising: responsive to a determination that a subject has cancer cells that express a T cell receptor comprising TRBC2, administering to the subject a multifunctional molecule disclosed herein, wherein the first antigen binding domain of the multifunctional molecule binds to TRBC2, wherein the multifunctional molecule is administered in an amount effective to treat the cancer. In one aspect, provide herein is a method of treating a cancer, e.g., a lymphoma or leukemia, e.g., a T cell lymphoma or leukemia, comprising: responsive to a determination that a subject has cancer cells that express a T cell receptor comprising TRBC1, administering to the subject a multifunctional molecule disclosed herein, wherein the first antigen binding domain of the multifunctional molecule binds to TRBC1, wherein the multifunctional molecule is administered in an amount effective to treat the cancer.

In one aspect, provide herein is a method of identifying a subject in need of treatment for cancer, e.g., a lymphoma or leukemia, e.g., a T cell lymphoma or leukemia or its premalignant state, using a multifunctional molecule disclosed herein, comprising determining (e.g., directly determining or indirectly determining, e.g., obtaining information regarding) whether a subject has cancer cells that express a T cell receptor comprising TRBC1 or TRBC2, wherein: responsive to a determination that the subject has cancer cells that express a T cell receptor comprising TRBC1, identifying the subject as a candidate for treatment using a multifunctional molecule comprising an antigen binding domain that binds to TRBC1, and optionally not as a candidate for treatment using a multifunctional molecule comprising an antigen binding domain that binds to TRBC2, or responsive to a determination that the subject has cancer cells that express a T cell receptor comprising TRBC2, identifying the subject as a candidate for treatment using a multifunctional molecule comprising an antigen binding domain that binds to TRBC2, and optionally not as a candidate for treatment using a multifunctional molecule comprising an antigen binding domain that binds to TRBC1.

In some embodiments, the method further comprises: responsive to identifying the subject as a candidate for treatment using a multifunctional molecule comprising an antigen binding domain that binds to TRBC1, treating the subject with (e.g., administering to the subject) a multifunctional molecule comprising an antigen binding domain that binds to TRBC1, or responsive to identifying the subject as a candidate for treatment using a multifunctional molecule comprising an antigen binding domain that binds to TRBC2, treating the subject with (e.g., administering to the subject) a multifunctional molecule comprising an antigen binding domain that binds to TRBC2.

In some embodiments of the aforementioned methods, the cancer is leukemia or lymphoma or its premalignant state. In some embodiments, the cancer is selected from Acquired immune deficiency syndrome (AIDS)-associated lymphoma, Angioimmunoblastic T-cell lymphoma, Adult T-cell leukemia/lymphoma, Burkitt lymphoma, Central nervous system (CNS) lymphoma, Diffuse large B-cell lymphoma (DLBCL), Lymphoblastic lymphoma, Mantle cell lymphoma (MCL), Peripheral T-cell lymphoma (PTCL) (e.g., Hepatosplenic T-cell lymphoma (HSGDTCL), Subcutaneous paniculitis-like T-cell lymphoma, or Enteropathy-associated T-cell lymphoma), Transformed follicular and transformed mucosa-associated lymphoid tissue (MALT) lymphomas, Cutaneous T-cell lymphoma (mycosis fungoides and Sézary syndrome), Follicular lymphoma, Lymphoplasmacytic lymphoma/Waldenström macroglobulinemia, Marginal zone B-cell lymphoma, Gastric mucosa-associated lymphoid tissue (MALT) lymphoma, Chronic lymphocytic leukemia/small-cell lymphocytic lymphoma (CLL/SLL), Extranodal T-/NK-cell lymphoma (nasal type), and Anaplastic large-cell lymphoma (e.g., primary cutaneous anaplastic large-cell lymphoma or systemic anaplastic large-cell lymphoma). In some embodiments, the cancer is Peripheral T-cell lymphoma (PTCL).

In one aspect, this invention provides a composition comprising a multifunctional molecule or an antibody molecule disclosed herein for use in a method of treating a subject having cancer.

Accordingly, in one aspect, the disclosure features multifunctional molecule, comprising:

(i) a first antigen binding domain that selectively binds to T cell receptor beta chain constant domain 1 (TRBC1) or T cell receptor beta chain constant domain 2 (TRBC2), and (ii) one, two, or all of:
  (a) an immune cell engager chosen from an NK cell engager (e.g., a molecule that binds to NKp30, NKp46, NKG2D, or CD16), T cell engager (e.g., that binds to a T cell antigen other than CD3), a B cell engager, a dendritic cell engager, or a macrophage cell engager; (b) a cytokine molecule or cytokine inhibitor molecule;
  (c) a death receptor signal engager; and
  (d) a stromal modifying moiety.

In another aspect, the disclosure features a multifunctional molecule, comprising:

(i) a first antigen binding domain that selectively targets lymphocytes expressing (e.g., on their surface, e.g., displaying) a T cell receptor comprising T cell receptor beta chain constant domain 1 (TRBC1), TRBC1, a T cell receptor comprising T cell receptor beta chain constant domain 2 (TRBC2), or TRBC2, and (ii) one, two, or all of:
  (a) an immune cell engager chosen from an NK cell engager (e.g., a molecule that binds to NKp30, NKp46, NKG2D, or CD16), a T cell engager (e.g., that binds to a T cell antigen other than CD3), a B cell engager, a dendritic cell engager, or a macrophage cell engager;
  (b) a cytokine molecule or cytokine inhibitor molecule;
  (c) a death receptor signal engager; and
  (d) a stromal modifying moiety.

In another aspect, the disclosure features a multifunctional molecule, comprising:

(i) a first antigen binding domain that preferentially binds to a tumor antigen on a lymphoma cell (e.g., T cell), e.g., a T cell receptor comprising T cell receptor beta chain constant domain 1 (TRBC1), TRBC1, a T cell receptor comprising T cell receptor beta chain constant domain 2 (TRBC2), or TRBC2, and (ii) one, two, or all of:
  (a) an immune cell engager chosen from an NK cell engager (e.g., a molecule that binds to NKp30, NKp46, NKG2D, or CD16), a T cell engager (e.g., that binds to a T cell antigen other than CD3), a B cell engager, a dendritic cell engager, or a macrophage cell engager;
  (b) a cytokine molecule or cytokine inhibitor molecule;
  (c) a death receptor signal engager; and
  (d) a stromal modifying moiety.

In another aspect, the disclosure features an antibody molecule, e.g., an IgM antibody molecule, comprising: (i) a first antigen binding domain that selectively binds to T cell receptor beta chain constant domain 1 (TRBC1) or T cell receptor beta chain constant domain 2 (TRBC2), and (ii) a complement activating domain that activates the complement pathway, e.g., by binding C1q.

In another aspect, the disclosure features multispecific or multifunctional molecules, or antibodies that include (i) an antigen binding domain that binds to a T cell receptor comprising T cell receptor beta chain constant domain 1 (TRBC1) or a T cell receptor comprising T cell receptor beta chain constant domain 2 (TRBC2); (ii) a antigen binding domain that binds to a tumor antigen antigen, wherein the tumor antigen is selected from the group consisting of Thymidine Kinase (TK1), Hypoxanthine-Guanine Phosphoribosyltransferase (HPRT), Receptor Tyrosine Kinase-Like Orphan Receptor 1 (ROR1), Mucin-1, Mucin-16 (MUC16), MUC1, Epidermal Growth Factor Receptor vIII (EGFRvIII), Mesothelin, Human Epidermal Growth Factor Receptor 2 (HER2), Mesothelin, EBNA-1, LEMD1, Phosphatidyl Serine, Carcinoembryonic Antigen (CEA), B-Cell Maturation Antigen (BCMA), Glypican 3 (GPC3), Follicular Stimulating Hormone receptor, Fibroblast Activation Protein (FAP), Erythropoietin-Producing Hepatocellular Carcinoma A2 (EphA2), EphB2, a Natural Killer Group 2D (NKG2D) ligand, Disialoganglioside 2 (GD2), CD2, CD3, CD4, CD5, CD7, CD8, CD19, CD20, CD22, CD24, CD30, CD33, CD38, CD44v6, CD45, CD56CD79b, CD97, CD117, CD123, CD133, CD138, CD171, CD179a, CD213A2, CD248, CD276, PSCA, CS-1, CLECL1, GD3, PSMA, FLT3, TAG72, EPCAM, IL-1, an integrin receptor, PRSS21, VEGFR2, PDGFR-β, SSEA-4, EGFR, NCAM, prostase, PAP, ELF2M, GM3, TEM7R, CLDN6, TSHR, GPRC5D, ALK, IGLL1 and combinations thereof. In some embodiments, the antigen is selected from the group consisting of CD2, CD3, CD4, CD5, CD7, CCR4, CD8, CD30, CD45, CD56.

In one embodiment, the disclosure features multispecific or multifunctional molecules, or antibodies that include (i) an antigen binding domain that binds to a T cell receptor comprising T cell receptor beta chain constant domain 1 (TRBC1) or a T cell receptor comprising T cell receptor beta chain constant domain 2 (TRBC2); (ii) a antigen binding domain that binds to a tumor antigen antigen, wherein the tumor antigen is CD19.

In another aspect, the disclosure features a nucleic acid molecule encoding a multifunctional molecule disclosed herein.

In another aspect, the disclosure features a vector, e.g., an expression vector, comprising the nucleic acid molecules disclosed herein.

In another aspect, the disclosure features a host cell comprising a nucleic acid molecule or vector disclosed herein.

In another aspect, the disclosure features a method of making, e.g., producing, a multifunctional molecule disclosed herein, comprising culturing a host cell disclosed herein under suitable conditions, e.g., conditions suitable for gene expression and/or homo- or heterodimerization.

In another aspect, the disclosure features a pharmaceutical composition comprising a multifunctional molecule disclosed herein.

In another aspect, the disclosure features a method of treating a cancer, comprising administering to a subject in need thereof a multifunctional molecule disclosed herein, wherein the multifunctional molecule is administered in an amount effective to treat the cancer. In some embodiments, the cancer is a T cell malignancy, e.g., a T cell lymphoma or a T cell leukemia. In some embodiments, the cancer is chosen from: T cell prolymphocytic leukemia, T cell large granular lymphocytic leukemia, Systemic EBV positive T cell lymphoproliferative disease of childhood, Hydroa vaccineform-like lymphoma, PTCL, PTCL-NOS (Not Otherwise Specified), Angioimmunoblastic T-cell lymphoma (AITL), Anaplastic Large cell Lymphoma (ALCT) ALK positive and ALK negative, Primary cutaneous anaplastic large cell lymphoma, Primary cutaneous gd Tcell lymphoma, Primary cutaneous CD8 positive aggressive epidermotropic cytotoxic T cell lymphoma, Primary cutaneous CD4 positive small/medium T cell lymphoma, Extranodal T cell lymphoma, Enteropathy-associated T cell Lymphoma (EATL), Hepatoslenic T cell lymphoma, Cutaneous T cell Lymphoma (CTCL) including CD 30 positive T cell lymphoproliferative disorders, Subcutanoeus panniculitis-like T cell lymphoma, Mycosis fugoides, Sezary Syndrome, lymphomatoid papulosis, T-cell Acute Lymphoblastic Leukemia (T-ALL), Adult T cell lymphoma, Monoclonal T cell proliferation of unknown significance. In some embodiments, the cancer is chosen from: anaplastic large cell lymphoma (ALCL); angioimmunoblastic T cell lymphoma; peripheral T cell lymphoma (PTCL), not otherwise specified (NOS); cutaneous T-cell lymphoma (CTCL); NKT cell lymphoma; Sézary syndrome; T acute lymphoblastic leukemia or lymphoma; adult T cell leukemia or lymphoma; T prolymphocytic leukemia; and T large granular leukemia. In some embodiments, the cancer is PTCL. In some embodiments, TRBC subtype expression is analyzed by flow cytometry analysis of, e.g., fresh tumor tissue. In some embodiments, the multifunctional molecule is used in combination with a second agent. In some embodiments, the second agent is a histone deacetylases (HDAC) inhibitor, e.g., romidepsin or belinostat. In some embodiments, the second agent is a kinase or enzyme inhibitor. In some embodiments, the second agent is a PI3K inhibitor, e.g., duvelisib. In some embodiments, the second agent is a farnesyltransferase inhibitor, e.g., tipifarnib. In some embodiments, the second agent is a SYK/JAK inhibitor, e.g., cerdulatinib. In some embodiments, the second agent is a chemotherapy. In some embodiments, the second agent is an anti-CD30 antibody. In some embodiments, the second agent is an IMiD.

In another aspect, the disclosure features a method of identifying a subject in need of treatment for cancer using a multifunctional molecule disclosed herein, comprising determining (e.g., directly determining or indirectly determining, e.g., obtaining information regarding) whether a subject has cancer cells that express a T cell receptor comprising TRBC1 or TRBC2, wherein: responsive to determining that the subject has cancer cells that express a T cell receptor comprising TRBC1, identifying the subject as a candidate for treatment using a multifunctional molecule comprising an antigen binding domain that binds to TRBC1, and optionally not as a candidate for treatment using a multifunctional molecule comprising an antigen binding domain that binds to TRBC2, and responsive to determining that the subject has cancer cells that express a T cell receptor comprising TRBC2, identifying the subject as a candidate for treatment using a multifunctional molecule comprising an antigen binding domain that binds to TRBC2, and optionally not as a candidate for treatment using a multifunctional molecule comprising an antigen binding domain that binds to TRBC1.

In another aspect, the disclosure features a method of evaluating a subject in need of treatment for cancer, e.g., a lymphoma, comprising determining (e.g., directly determining or indirectly determining, e.g., obtaining information regarding) whether a subject has cancer cells that express a T cell receptor comprising TRBC1 or TRBC2.

In another aspect, the agents under discussion can have a potential to treat autoimmune conditions as Type 1 diabetes, Rheumatoid arthritis, Psoriasis/psoriatic arthritis, Multiple sclerosis, Systemic lupus erythematosus, Inflammatory bowel disease, Ulcerative colitis, Addison's disease, Graves' disease, Sjögren's syndrome, Hashimoto's thyroiditis, Myasthenia gravis, Autoimmune vasculitis, Pernicious anemia and Celiac disease.

Additional features of any of the aforesaid multifunctional molecules, nucleic acids, vectors, host cells, or methods include one or more of the following enumerated embodiments.

Those skilled in the art will recognize, or be able to ascertain using no more than routine experimentation, many equivalents to the specific embodiments of the invention described herein. Such equivalents are intended to be encompassed by the following enumerated embodiments.

BRIEF DESCRIPTION OF THE DRAWINGS

FIG. 1A depicts an anti-TRBC1 antibody fused to an anti-NKp30 scFv. The anti-TRBC1 antibody comprises two heavy chains and two light chains. The anti-NKp30 scFv is fused to the N-terminus of one heavy chain of the anti-TRBC1 antibody. FIG. 1B depicts an antibody molecule comprising an anti-TRBC1 Fab, an anti-NKp30 scFv, and an Fc dimer. The Fc dimer comprises two Fc chains. The C-terminus of the heavy chain of the anti-TRBC1 Fab is fused to the N-terminus of one Fc chain. The anti-NKp30 scFv is fused to the N-terminus of the other Fc chain. FIGS. 1C and 1D depict an anti-TRBC1 antibody fused to two anti-NKp30 scFvs. The anti-TRBC1 antibody comprises two heavy chains and two light chains. In FIG. 1C, the two anti-NKp30 scFvs are fused to the C-terminus of the two light chains of the anti-TRBC1 antibody, respectively. In FIG. 1D, the two anti-NKp30 scFvs are fused to the N-terminus of the two heavy chains of the anti-TRBC1 antibody, respectively.

FIGS. 2A and 2D depict an antibody molecule comprising an anti-TRBC1 Fab, a trimeric TRAIL molecule, and an Fc dimer. FIGS. 2B and 2E depict an antibody molecule comprising an anti-TRBC1 Fab, a dimeric TRAIL molecule, and an Fc dimer. FIGS. 2C and 2F depict an antibody molecule comprising an anti-TRBC1 Fab, a monomeric TRAIL molecule, and an Fc dimer. The Fc dimer comprises two Fc chains. The C-terminus of the heavy chain of the anti-TRBC1 Fab is fused to the N-terminus of one Fc chain. The trimeric, dimeric, or monomeric TRAIL molecule is fused to the N-terminus of the other Fc chain. In some embodiments, the antibody molecule depicted in FIG. 2A comprises the amino acid sequences of SEQ ID NOs: 6169, 6167, and 6159. In some embodiments, the antibody molecule depicted in FIG. 2B comprises the amino acid sequences of SEQ ID NOs: 6169, 6167, and 6158. In some embodiments, the antibody molecule depicted in FIG. 2C comprises the amino acid sequences of SEQ ID NOs: 6169, 6167, and 6157. In some embodiments, then antibody molecule depicted in FIG. 2D comprises the amino acid sequences of SEQ ID NOs: 6169, 6167, and 6162. In some embodiments, then antibody molecule depicted in FIG. 2E comprises the amino acid sequences of SEQ ID NOs: 6169, 6167, and 6161. In some embodiments, then antibody molecule depicted in FIG. 2F comprises the amino acid sequences of SEQ ID NOs: 6169, 6167, and 6160.

FIG. 3A depicts a multispecific antibody (e.g., a bispecific antibody) comprising an anti-TRBC1 Fab, an anti-DR5 scFv, and an Fc dimer. The Fc dimer comprises two Fc chains. The C-terminus of the heavy chain of the anti-TRBC1 Fab is fused to the N-terminus of one Fc chain. The anti-DR5 scFv is fused to the N-terminus of the other Fc chain. FIG. 3B depicts an anti-TRBC1 antibody fused to two anti-DR5 scFvs. The anti-TRBC1 antibody comprises two heavy chains and two light chains. The two anti-DR5 scFvs are fused to the C-terminus of the two light chains of the anti-TRBC1 antibody, respectively. In some embodiments, the multispecific antibody depicted in FIG. 3A comprises the amino acid sequences of SEQ ID NOs: 6169, 6167, and 6163. In some embodiments, the multispecific antibody depicted in FIG. 3B comprises the amino acid sequences of SEQ ID NOs: 6170 and 6168.

FIGS. 4A and 4B shows the alignment of the H131 source mouse VH and VL framework 1, CDR 1, framework 2, CDR 2, framework 3, CDR3, and framework 4 regions with their respective humanized sequences. Kabat CDRs are shown in bold, Chothia CDRs are shown in italics, and combined CDRs are shown in boxes. The framework positions that were back mutated are double underlined. FIG. 4A shows VH sequences for murine H131 (SEQ ID NO: 1) and humanized H131 (SEQ ID NO: 9). FIG. 4B shows VL sequences for murine H131 (SEQ ID NO: 2) and humanized H131 (SEQ ID NO: 10 and SEQ ID NO: 11).

FIGS. 5A and 5B shows the alignment of the 16G8 source mouse VH and VL framework 1, CDR 1, framework 2, CDR 2, framework 3, CDR3, and framework 4 regions with their respective humanized sequences. Kabat CDRs are shown in bold, Chothia CDRs are shown in italics, and combined CDRs are shown in boxes. The framework positions that were back mutated are double underlined. FIG. 5A shows VH sequences for murine 16G8 (SEQ ID NO: 15) and humanized 16G8 (SEQ ID NOs: 23-25). FIG. 5B shows VL sequences for murine 16G8 (SEQ ID NO: 16) and humanized 16G8 (SEQ ID NOs: 26-30).

FIG. 13A is a graph showing % CD4+ divided. FIG. 13B is a graph showing % CD8+ divided. FIG. 13C is a graph showing % CD69-CD25+ of CD4+. FIG. 13D is a graph showing % CD69-CD25+ of CD8+.

FIGS. 14A-14D are schematic representations of anti-TRBC1/NKp30 antibodies. In FIGS. 14B and 14D, "460" indicates a Fab based on BJM0460; "578" indicates a Fab based on BJM0578; "407" indicates a scFv (FIG. 18B) or a Fab (FIG. 14D) based on BJM0407; "411" indicates a scFv (FIG. 18B) or a Fab (FIG. 14D) based on BJM0411; and "N297A" indicates that the antibody comprises an N297A mutation in the Fc region.

FIGS. 15A-15D are graphs showing binding of the indicated antibodies to NK cell line KHYG-1 (FIG. 15A) and TRBC1+ Jurkat cells (FIG. 15B). FIG. 15C is a table providing information on the antibodies tested. FIG. 15D is a table providing EC50 for binding to KHYG-1 cells or TRBC1+ Jurkat cells.

FIG. 18A shows % CD69+CD107a+ NK cells. FIG. 18B shows the level of IFNγ. FIG. 18C shows the level of TNFα.

FIG. 19A shows the level of IFNγ. FIG. 19B shows the level of TNFα.

FIG. 26A shows binding of B7-H6 to NKp30. FIG. 26B shows binding of BJM1042 to NKp30. FIG. 26C shows binding of B7-H6 to NKp30 in the presence of varying concentrations of the indicated antibodies.

FIG. 27A shows the study design. FIG. 27B shows tumor volume under the indicated treatments. FIG. 27C is a water plot showing % change in tumor volume on Day 3 post treatment. The following treatment groups are shown in FIG. 27C from left to right: No NK, PBS; No NK, TRBC1 x NKp30; NK, PBS; NK, TRBC1; NK, NKp30; and NK+1 mpk BJM1042.

FIG. 28A shows the study design. FIG. 28B shows tumor volume under the indicated treatments.

FIG. 31A is a schematic representation of a bispecific antibody comprising anti-TRBC2 Fab and anti-NKp30 ScFv arms. FIG. 31B shows a design similar to that of FIG. 31A, lacking the NK-p30 binding chain.

FIG. 32A shows binding to TRBC2+ HPB-ALL cells; FIG. 32B shows binding to NKp30+ KHYG-1 cells; FIG. 32C shows binding to TRBC1+ Jurkat cells.

FIG. 33A, data showing TRBC2x NKp30 bispecifics selectively kill TRBC2+ HPB-ALL cells with KHYG-1 NK cells as effectors in vitro. FIG. 33B, data showing TRBC2x NKp30 bispecifics do not kill TRBC1+ Jurkat cells in vitro. FIG. 33C, data showing TRBC2x NKp30 bispecifics selectively kill TRBC2+ HPB-ALL cells with primary NK cells as effectors in vitro. FIG. 33D, data showing TRBC2x NKp30 bispecifics do not kill TRBC1+ Jurkat cells with primary NK cells in vitro.

FIG. 34A, data showing primary NK cell activation in cocultures with TRBC2+ HPB-ALL cells. FIG. 34B, data showing lack of primary NK cell activation in cocultures with TRBC1+ Jurkat cells.

FIG. 35A shows increased IFNγ secretion in cocultures of HPB-ALL cells and primary NK cells in vitro. FIG. 35B shows lack IFNγ secretion in cocultures of Jurkat cells and primary NK cells in vitro. FIG. 35C shows increased TNFα secretion in cocultures of HPB-ALL cells and primary NK cells in vitro. FIG. 35D shows lack TNFα secretion in cocultures of Jurkat cells and primary NK cells in vitro.

FIG. 36A, data showing TRBC2x NKp30 bispecifics selectively kill TRBC2+ cells derived from a patient with Adult T-cell Leukemia/Lymphoma (ATLL) (PDX2) with KHYG-1 cells as effectors. FIG. 36B, data showing TRBC2x NKp30 bispecifics selectively kill TRBC2+ cells derived from a patient with Hepatosplenic T-cell Lymphoma (HTCL) (PDX5) with KHYG-1 cells as effectors in vitro. FIG. 36C, data showing TRBC2x NKp30 bispecifics does not kill TRBC1+ cells derived from a patient with Adult T-cell Leukemia/Lymphoma (ATLL) (PDX3) with KHYG-1 cells as effectors in vitro.

DETAILED DESCRIPTION OF THE INVENTION

Figure 1A:
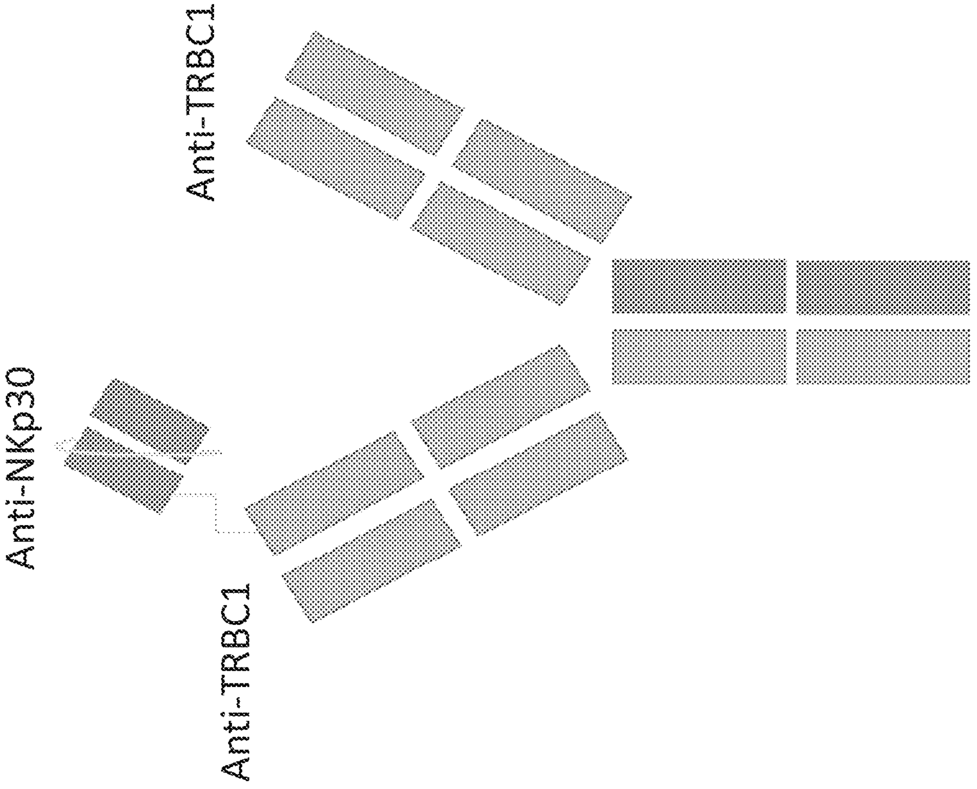
FIGS. 1A-1D are schematic representations of exemplary formats and configurations of multispecific antibodies (e.g., bispecific antibodies) that bind to TRBC1 and NKp30.

Disclosed herein are multifunctional molecules (also referred to herein as "multispecific molecules") that include a plurality of (e.g., two or more) functionalities (or binding specificities), comprising (i) an antigen binding domain that preferentially binds to TRBC1 or a TRBC2, and (ii) one, two, or all of: (a) an immune cell engager chosen from a T cell engager, an NK cell engager (e.g., a molecule that binds to NKp30, NKp46, NKG2D, or CD16), a B cell engager, a dendritic cell engager, or a macrophage cell engager; (b) a cytokine molecule; and (c) a stromal modifying moiety. Also disclosed herein are antibody molecules comprising an antigen binding domain that preferentially binds to TRBC1 or TRBC2. In some embodiments, the antigen binding domain that binds to TRBC1 comprises a sequence or part of a sequence found in Table 1, Table 2A or Table 2B, Table 3A or Table 3B, Table 4, Table 5A or Table 5B, Table 5A or Table 5B, Table 6, Table 7, Table 8 or Table 16. In some embodiments, the antigen binding domain that binds to TRBC2 comprises a sequence or part of a sequence found in Table 9A or Table 9B, Table 10, Table 11, Table 12, Table 13, Table 14, Table 15, Table 17 or Table 39. In some embodiments, the immune cell engager comprises an NK cell engager comprising a sequence or part of a sequence found in Table 20A or Table 20B, Table 22, Table 23A or Table 23B, Table 24, Table 25, Table 26, Table 21A or Table 21B, and Table 17. In some embodiments, the antigen binding domain comprises a sequence or part of a sequence found in Table 1, Table 2, Table 3A or Table 3B, Table 4, Table 7, Table 8, Table 16 and the immune cell engager comprises an NK cell engager comprising a sequence or part of a sequence found in Table 20A or Table 20B, Table 22, Table 23A or Table 23B, Table 24, Table 25, Table 26, Table 21A or Table 21B, and Table 17. In some embodiments, the antigen binding domain comprises a sequence or part of a sequence found in Table 9A or Table 9B, Table 10, Table 11, Table 12, Table 13, Table 14, Table 15, Table 17, Table 39, and the immune cell engager comprises an NK cell engager comprising a sequence or part of a sequence found in Table 20A or Table 20B, Table 22, Table 23A or Table 23B, Table 24, Table 25, Table 26, Table 21A or Table 21B, and Table 17.

In an embodiment, the multispecific or multifunctional molecule is a bispecific (or bifunctional) molecule, a trispecific (or trifunctional) molecule, or a tetraspecific (or tetrafunctional) molecule.

In some embodiments, the multifunctional molecule comprises an antigen binding domain that binds a tumor antigen on the surface of a T cell receptor comprising TRBC1 targets immune cells (e.g., via the immune cell engager) to lymphoma cells (e.g., T cells) that exhibit T cell receptors comprising TRBC1. In some embodiments, the multifunctional molecule comprises an antigen binding domain that binds a tumor antigen on the surface of a T cell receptor comprising TRBC2 targets immune cells (e.g., via the immune cell engager) to lymphoma cells (e.g., T cells) that exhibit T cell receptors comprising TRBC2.

Without being bound by theory, the multispecific or multifunctional molecules disclosed herein are expected to localize (e.g., bridge) and/or activate an immune cell (e.g., an immune effector cell chosen from a T cell, an NK cell, a B cell, a dendritic cell or a macrophage), in the presence of a cell (e.g., a cancer cell, e.g., lymphoma cell, e.g., T cell) expressing a T cell receptor comprising TRBC1 or TRBC2, e.g., on the surface. Increasing the proximity and/or activity of the immune cell, in the presence of the cell (e.g., cancer cell, e.g., lymphoma cell, e.g., T cell) expressing a T cell receptor comprising TRBC1 or TRBC2, using the multispecific or multifunctional molecules described herein is expected to enhance an immune response against the target cell, thereby providing a more effective therapy.

Without being bound by theory, it is thought that T cells from either normal or inflamed conditions or virus-specific T cell populations contain both TRBC1+ and TRBC2+ compartments, whereas malignancies are restricted to either TRBC1 or TRBC2. By utilizing, in some embodiments, a multispecific or multifunctional molecule specific for a T cell receptor comprising TRBC1 or a T cell receptor comprising TRBC2, but not with specificity for both types of T cell receptors, it is expected that only a subset of normal T cells along with the entire set of malignant T cells expressing either TRBC1 or TRBC2 are killed, while sparing the other normal compartment of either TRBC1+ or TRBC2+ T cells. This specificity in the mechanism of agents aids in increasing proximity or activity of immune cells to either TRBC1+ or TRBC2+ malignant cells while preserving a subset of normal T cells. Due to this it mitigates pan T cell aplasia leading to the deleterious effects. In this way, it is thought that use of the multispecific or multifunctional molecules disclosed herein may increase the proximity or activity of immune cells toward cancer cells (e.g., lymphoma cells, e.g., T cells) and a compartment of normal T cells (either TRBC1 or TRBC2), without necessarily increasing proximity or activity of immune cells toward the other compartment of T cells.

Novel multifunctional, e.g., multispecific, molecules that include (i) a stromal modifying moiety and (ii) an antigen binding domain that preferentially binds to tumor antigen on a lymphoma cell (e.g., T cell), e.g., a T cell receptor comprising TRBC1 or a T cell receptor comprising TRBC2 are disclosed. Without being bound by theory, the multifunctional molecules disclosed herein are believed to inter alia target (e.g., localize to) a cancer site, and alter the tumor stroma, e.g., alter the tumor microenvironment near the cancer site. The multifunctional molecules can further include one or both of: an immune cell engager (e.g., chosen from one, two, three, or all of a T cell engager, NK cell engager, a B cell engager, a dendritic cell engager, or a macrophage cell engager); and/or a cytokine molecule. Accordingly, provided herein are, inter alia, multifunctional, e.g., multispecific molecules, that include the aforesaid moieties, nucleic acids encoding the same, methods of producing the aforesaid molecules, and methods of treating a cancer using the aforesaid molecules.

Accordingly, provided herein are, inter alia, multispecific or multifunctional molecules (e.g., multispecific or multifunctional antibody molecules) that include the aforesaid moieties, nucleic acids encoding the same, methods of producing the aforesaid molecules, and methods of treating a disease or disorder, e.g., cancer, using the aforesaid molecules.

Definitions

In some embodiments, the multifunctional molecule includes an immune cell engager. "An immune cell engager" refers to one or more binding specificities that bind and/or activate an immune cell, e.g., a cell involved in an immune response. In embodiments, the immune cell is chosen from a T cell, an NK cell, a B cell, a dendritic cell, and/or the macrophage cell. The immune cell engager can be an antibody molecule, a receptor molecule (e.g., a full length receptor, receptor fragment, or fusion thereof (e.g., a receptor-Fc fusion)), or a ligand molecule (e.g., a full length ligand, ligand fragment, or fusion thereof (e.g., a ligand-Fc fusion)) that binds to the immune cell antigen (e.g., the T cell, the NK cell antigen, the B cell antigen, the dendritic cell antigen, and/or the macrophage cell antigen). In embodiments, the immune cell engager specifically binds to the target immune cell, e.g., binds preferentially to the target immune cell. For example, when the immune cell engager is an antibody molecule, it binds to an immune cell antigen (e.g., a T cell antigen, an NK cell antigen, a B cell antigen, a dendritic cell antigen, and/or a macrophage cell antigen) with a dissociation constant of less than about 10 nM.

In some embodiments, the multifunctional molecule includes a cytokine molecule. As used herein, a "cytokine molecule" refers to full length, a fragment or a variant of a cytokine; a cytokine further comprising a receptor domain, e.g., a cytokine receptor dimerizing domain; or an agonist of a cytokine receptor, e.g., an antibody molecule (e.g., an agonistic antibody) to a cytokine receptor, that elicits at least one activity of a naturally-occurring cytokine. In some embodiments the cytokine molecule is chosen from interleukin-2 (IL-2), interleukin-7 (IL-7), interleukin-12 (IL-12), interleukin-15 (IL-15), interleukin-18 (IL-18), interleukin-21 (IL-21), or interferon gamma, or a fragment or variant thereof, or a combination of any of the aforesaid cytokines. The cytokine molecule can be a monomer or a dimer. In embodiments, the cytokine molecule can further include a cytokine receptor dimerizing domain. In other embodiments, the cytokine molecule is an agonist of a cytokine receptor, e.g., an antibody molecule (e.g., an agonistic antibody) to a cytokine receptor chosen from an IL-15Ra or IL-21R.

As used herein, the term "molecule" as used in, e.g., antibody molecule, cytokine molecule, receptor molecule, includes full-length, naturally-occurring molecules, as well as variants, e.g., functional variants (e.g., truncations, fragments, mutated (e.g., substantially similar sequences) or derivatized form thereof), so long as at least one function and/or activity of the unmodified (e.g., naturally-occurring) molecule remains.

In some embodiments, the multifunctional molecule includes a stromal modifying moiety. A "stromal modifying moiety," as used herein refers to an agent, e.g., a protein (e.g., an enzyme), that is capable of altering, e.g., degrading a component of, the stroma. In embodiments, the component of the stroma is chosen from, e.g., an ECM component, e.g., a glycosaminoglycan, e.g., hyaluronan (also known as hyaluronic acid or HA), chondroitin sulfate, chondroitin, dermatan sulfate, heparin sulfate, heparin, entactin, tenascin, aggrecan and keratin sulfate; or an extracellular protein, e.g., collagen, laminin, elastin, fibrinogen, fibronectin, and vitronectin.

Certain terms are defined below.

As used herein, the articles "a" and "an" refer to one or more than one, e.g., to at least one, of the grammatical object of the article. The use of the words "a" or "an" when used in conjunction with the term "comprising" herein may mean "one," but it is also consistent with the meaning of "one or more," "at least one," and "one or more than one."

As used herein, "about" and "approximately" generally mean an acceptable degree of error for the quantity measured given the nature or precision of the measurements. Exemplary degrees of error are within 20 percent (%), typically, within 10%, and more typically, within 5% of a given range of values.

"Antibody molecule" as used herein refers to a protein, e.g., an immunoglobulin chain or fragment thereof, comprising at least one immunoglobulin variable domain sequence. An antibody molecule encompasses antibodies (e.g., full-length antibodies) and antibody fragments. In an embodiment, an antibody molecule comprises an antigen binding or functional fragment of a full length antibody, or a full length immunoglobulin chain. For example, a full-length antibody is an immunoglobulin (Ig) molecule (e.g., an IgG antibody) that is naturally occurring or formed by normal immunoglobulin gene fragment recombinatorial processes). In embodiments, an antibody molecule refers to an immunologically active, antigen-binding portion of an immunoglobulin molecule, such as an antibody fragment. An antibody fragment, e.g., functional fragment, is a portion of an antibody, e.g., Fab, Fab', $F(ab')_2$, $F(ab)_2$, variable fragment (Fv), domain antibody (dAb), or single chain variable fragment (scFv). A functional antibody fragment binds to the same antigen as that recognized by the intact (e.g., full-length) antibody. The terms "antibody fragment" or "functional fragment" also include isolated fragments consisting of the variable regions, such as the "Fv" fragments consisting of the variable regions of the heavy and light chains or recombinant single chain polypeptide molecules in which light and heavy variable regions are connected by a peptide linker ("scFv proteins"). In some embodiments, an antibody fragment does not include portions of antibodies without antigen binding activity, such as Fc fragments or single amino acid residues. Exemplary antibody molecules include full length antibodies and antibody fragments, e.g., dAb (domain antibody), single chain, Fab, Fab', and $F(ab')_2$ fragments, and single chain variable fragments (scFvs).

As used herein, an "immunoglobulin variable domain sequence" refers to an amino acid sequence which can form the structure of an immunoglobulin variable domain. For example, the sequence may include all or part of the amino acid sequence of a naturally occurring variable domain. For example, the sequence may or may not include one, two, or more N- or C-terminal amino acids, or may include other alterations that are compatible with formation of the protein structure.

In embodiments, an antibody molecule is monospecific, e.g., it comprises binding specificity for a single epitope. In some embodiments, an antibody molecule is multispecific, e.g., it comprises a plurality of immunoglobulin variable domain sequences, where a first immunoglobulin variable domain sequence has binding specificity for a first epitope and a second immunoglobulin variable domain sequence has binding specificity for a second epitope. In some embodiments, an antibody molecule is a bispecific antibody molecule. "Bispecific antibody molecule" as used herein refers to an antibody molecule that has specificity for more than one (e.g., two, three, four, or more) epitope and/or antigen.

"Antigen" (Ag) as used herein refers to a molecule that can provoke an immune response, e.g., involving activation of certain immune cells and/or antibody generation. Any macromolecule, including almost all proteins or peptides, can be an antigen. Antigens can also be derived from genomic recombinant or DNA. For example, any DNA comprising a nucleotide sequence or a partial nucleotide sequence that encodes a protein capable of eliciting an immune response encodes an "antigen." In embodiments, an antigen does not need to be encoded solely by a full length nucleotide sequence of a gene, nor does an antigen need to be encoded by a gene at all. In embodiments, an antigen can be synthesized or can be derived from a biological sample, e.g., a tissue sample, a tumor sample, a cell, or a fluid with other biological components. As used, herein a "tumor antigen" or interchangeably, a "cancer antigen" includes any molecule present on, or associated with, a cancer, e.g., a cancer cell or a tumor microenvironment that can provoke an immune response. As used, herein an "immune cell antigen" includes any molecule present on, or associated with, an immune cell that can provoke an immune response.

The "antigen-binding site," or "binding portion" of an antibody molecule refers to the part of an antibody molecule, e.g., an immunoglobulin (Ig) molecule, that participates in antigen binding. In embodiments, the antigen binding site is formed by amino acid residues of the variable (V) regions of the heavy (H) and light (L) chains. Three highly divergent stretches within the variable regions of the heavy and light chains, referred to as hypervariable regions, are disposed between more conserved flanking stretches called "framework regions," (FRs). FRs are amino acid sequences that are naturally found between, and adjacent to, hypervariable regions in immunoglobulins. In embodiments, in an antibody molecule, the three hypervariable regions of a light chain and the three hypervariable regions of a heavy chain are disposed relative to each other in three dimensional space to form an antigen-binding surface, which is complementary to the three-dimensional surface of a bound antigen. The three hypervariable regions of each of the heavy and light chains are referred to as “complementarity-determining regions,” or “CDRs.” The framework region and CDRs have been defined and described, e.g., in Kabat, E. A., et al. (1991) Sequences of Proteins of Immunological Interest, Fifth Edition, U.S. Department of Health and Human Services, NIH Publication No. 91-3242, and Chothia, C. et al. (1987) J. Mol. Biol. 196:901-917. Each variable chain (e.g., variable heavy chain and variable light chain) is typically made up of three CDRs and four FRs, arranged from amino-terminus to carboxy-terminus in the amino acid order: FR1, CDR1, FR2, CDR2, FR3, CDR3, and FR4.

As used herein, the terms “T cell receptor beta variable chain,” “TCRβV,” “TCRβ V,” “TCR βV,” “TCRβv,” “TCR βv,” “TCRβ v,” “T cell receptor variable beta chain,” “TCRβV,” “TCR Vβ,” “TCRV β,” “TCRβV,” “TCRv β,” or “TCR vβ,” are used interchangeably herein and refer to an extracellular region of the T cell receptor beta chain which comprises the antigen recognition domain of the T cell receptor. The term TCRβV includes isoforms, mammalian, e.g., human TCRβV, species homologs of human and analogs comprising at least one common epitope with TCRβV. Human TCRβV comprises a gene family comprising subfamilies including, but not limited to: a TCRβ V6 subfamily, a TCRβ V10 subfamily, a TCRβ V12 subfamily, a TCRβ V5 subfamily, a TCRβ V7 subfamily, a TCRβ V11 subfamily, a TCRβ V14 subfamily, a TCRβ V16 subfamily, a TCRβ V18 subfamily, a TCRβ V9 subfamily, a TCRβ V13 subfamily, a TCRβ V4 subfamily, a TCRβ V3 subfamily, a TCRβ V2 subfamily, a TCRβ V15 subfamily, a TCRβ V30 subfamily, a TCRβ V19 subfamily, a TCRβ V27 subfamily, a TCRβ V28 subfamily, a TCRβ V24 subfamily, a TCRβ V20 subfamily, TCRβ V25 subfamily, or a TCRβ V29 subfamily. In some embodiments, the TCRβ V6 subfamily comprises: TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01. In some embodiments, TCRβV comprises TCRβ V6-5*01. TCRβ V6-5*01 is also known as TRBV65; TCRβV 6S5; TCRβV 13S1, or TCRβV 13.1. The amino acid sequence of TCRβ V6-5*01, e.g., human TCRβ V6-5*01, is known in that art, e.g., as provided by IMGT ID L36092.

“Cancer” as used herein can encompass all types of oncogenic processes and/or cancerous growths. In embodiments, cancer includes primary tumors as well as metastatic tissues or malignantly transformed cells, tissues, or organs. In embodiments, cancer encompasses all histopathologies and stages, e.g., stages of invasiveness/severity, of a cancer. In embodiments, cancer includes relapsed and/or resistant cancer. The terms “cancer” and “tumor” can be used interchangeably. For example, both terms encompass solid and liquid tumors. As used herein, the term “cancer” or “tumor” includes premalignant, as well as malignant cancers and tumors.

As used herein, an “immune cell” refers to any of various cells that function in the immune system, e.g., to protect against agents of infection and foreign matter. In embodiments, this term includes leukocytes, e.g., neutrophils, eosinophils, basophils, lymphocytes, and monocytes. Innate leukocytes include phagocytes (e.g., macrophages, neutrophils, and dendritic cells), mast cells, eosinophils, basophils, and natural killer cells. Innate leukocytes identify and eliminate pathogens, either by attacking larger pathogens through contact or by engulfing and then killing microorganisms, and are mediators in the activation of an adaptive immune response. The cells of the adaptive immune system are special types of leukocytes, called lymphocytes. B cells and T cells are important types of lymphocytes and are derived from hematopoietic stem cells in the bone marrow. B cells are involved in the humoral immune response, whereas T cells are involved in cell-mediated immune response. The term “immune cell” includes immune effector cells.

“Immune effector cell,” as that term is used herein, refers to a cell that is involved in an immune response, e.g., in the promotion of an immune effector response. Examples of immune effector cells include, but are not limited to, T cells, e.g., alpha/beta T cells and gamma/delta T cells, B cells, natural killer (NK) cells, natural killer T (NK T) cells, and mast cells.

The term “effector function” or “effector response” refers to a specialized function of a cell. Effector function of a T cell, for example, may be cytolytic activity or helper activity including the secretion of cytokines.

The compositions and methods of the present invention encompass polypeptides and nucleic acids having the sequences specified, or sequences substantially identical or similar thereto, e.g., sequences at least 80%, 85%, 90%, 95% identical or higher to the sequence specified. In the context of an amino acid sequence, the term “substantially identical” is used herein to refer to a first amino acid that contains a sufficient or minimum number of amino acid residues that are i) identical to, or ii) conservative substitutions of aligned amino acid residues in a second amino acid sequence such that the first and second amino acid sequences can have a common structural domain and/or common functional activity. For example, amino acid sequences that contain a common structural domain having at least about 80%, 85%, 90%, 91%, 92%, 93%, 94%, 95%, 96%, 97%, 98% or 99% identity to a reference sequence, e.g., a sequence provided herein.

In the context of nucleotide sequence, the term “substantially identical” is used herein to refer to a first nucleic acid sequence that contains a sufficient or minimum number of nucleotides that are identical to aligned nucleotides in a second nucleic acid sequence such that the first and second nucleotide sequences encode a polypeptide having common functional activity, or encode a common structural polypeptide domain or a common functional polypeptide activity. For example, nucleotide sequences having at least about 80%, 85%, 90%, 91%, 92%, 93%, 94%, 95%, 96%, 97%, 98% or 99% identity to a reference sequence, e.g., a sequence provided herein.

The term “variant” refers to a polypeptide that has a substantially identical amino acid sequence to a reference amino acid sequence, or is encoded by a substantially identical nucleotide sequence. In some embodiments, the variant is a functional variant.

The term “functional variant” refers to a polypeptide that has a substantially identical amino acid sequence to a reference amino acid sequence, or is encoded by a substantially identical nucleotide sequence, and is capable of having one or more activities of the reference amino acid sequence.

The term “scFv” refers to a fusion protein comprising at least one antibody fragment comprising a variable region of a light chain and at least one antibody fragment comprising a variable region of a heavy chain, wherein the light and heavy chain variable regions are contiguously linked via a short flexible polypeptide linker, and capable of being expressed as a single chain polypeptide, and wherein the scFv retains the specificity of the intact antibody from which it is derived. Unless specified, as used herein an scFv may have the $V_L$ and $V_H$ variable regions in either order, e.g., with respect to the N-terminal and C-terminal ends of the polypeptide, the scFv may comprise $V_L$-linker-$V_H$ or may comprise $V_H$-linker-$V_L$.

The terms "complementarity determining region" or "CDR," are used interchangeably herein and refer to the sequences of amino acids within antibody variable regions which confer antigen specificity and binding affinity. For example, in general, there are three CDRs in each heavy chain variable region (e.g., HCDR1, HCDR2, and HCDR3) and three CDRs in each light chain variable region (LCDR1, LCDR2, and LCDR3). The precise amino acid sequence boundaries of a given CDR can be determined using any of a number of well-known schemes, including those described by Kabat et al. (1991), "Sequences of Proteins of Immunological Interest," 5th Ed. Public Health Service, National Institutes of Health, Bethesda, Md. ("Kabat" numbering scheme), Al-Lazikani et al., (1997) JMB 273, 927-948 ("Chothia" numbering scheme), or a combination thereof. Under the Kabat numbering scheme, in some embodiments, the CDR amino acid residues in the heavy chain variable domain ($V_H$) are numbered 31-35 (HCDR1), 50-65 (HCDR2), and 95-102 (HCDR3); and the CDR amino acid residues in the light chain variable domain ($V_L$) are numbered 24-34 (LCDR1), 50-56 (LCDR2), and 89-97 (LCDR3). Under the Chothia numbering scheme, in some embodiments, the CDR amino acids in the $V_H$ are numbered 26-32 (HCDR1), 52-56 (HCDR2), and 95-102 (HCDR3); and the CDR amino acid residues in the $V_L$ are numbered 26-32 (LCDR1), 50-52 (LCDR2), and 91-96 (LCDR3). In a combined Kabat and Chothia numbering scheme, in some embodiments, the CDRs correspond to the amino acid residues that are part of a Kabat CDR, a Chothia CDR, or both. For instance, in some embodiments, the CDRs correspond to amino acid residues 26-35 (HCDR1), 50-65 (HCDR2), and 95-102 (HCDR3) in a $V_H$, e.g., a mammalian $V_H$, e.g., a human $V_H$; and amino acid residues 24-34 (LCDR1), 50-56 (LCDR2), and 89-97 (LCDR3) in a $V_L$, e.g., a mammalian $V_L$, e.g., a human $V_L$.

"Humanized" forms of non-human (e.g., murine) antibodies are chimeric immunoglobulins, immunoglobulin chains or fragments thereof (such as Fv, Fab, Fab', F(ab')2 or other antigen-binding subsequences of antibodies) which contain minimal sequence derived from non-human immunoglobulin. For the most part, humanized antibodies and antibody fragments thereof are human immunoglobulins (recipient antibody or antibody fragment) in which residues from a complementary-determining region (CDR) of the recipient are replaced by residues from a CDR of a non-human species (donor antibody) such as mouse, rat or rabbit having the desired specificity, affinity, and capacity. In some instances, Fv framework region (FR) residues of the human immunoglobulin are replaced by corresponding non-human residues. Furthermore, a humanized antibody/antibody fragment can comprise residues which are found neither in the recipient antibody nor in the imported CDR or framework sequences. These modifications can further refine and optimize antibody or antibody fragment performance. In general, the humanized antibody or antibody fragment thereof will comprise substantially all of at least one, and typically two, variable domains, in which all or substantially all of the CDR regions correspond to those of a non-human immunoglobulin and all or a significant portion of the FR regions are those of a human immunoglobulin sequence. The humanized antibody or antibody fragment can also comprise at least a portion of an immunoglobulin constant region (Fc), typically that of a human immunoglobulin. For further details, see Jones et al., Nature, 321: 522-525, 1986; Reichmann et al., Nature, 332: 323-329, 1988; Presta, Curr. Op. Struct. Biol., 2: 593-596, 1992.

"Fully human" refers to an immunoglobulin, such as an antibody or antibody fragment, where the whole molecule is of human origin or consists of an amino acid sequence identical to a human form of the antibody or immunoglobulin.

The term "specifically binds," refers to an antibody, or a ligand, which recognizes and binds with a cognate binding partner (e.g., a stimulatory and/or costimulatory molecule present on a T cell) protein present in a sample, but which antibody or ligand does not substantially recognize or bind other molecules in the sample.

As used herein, an "immune cell" refers to any of various cells that function in the immune system, e.g., to protect against agents of infection and foreign matter. In embodiments, this term includes leukocytes, e.g., neutrophils, eosinophils, basophils, lymphocytes, and monocytes. Innate leukocytes include phagocytes (e.g., macrophages, neutrophils, and dendritic cells), mast cells, eosinophils, basophils, and natural killer cells. Innate leukocytes identify and eliminate pathogens, either by attacking larger pathogens through contact or by engulfing and then killing microorganisms, and are mediators in the activation of an adaptive immune response. The cells of the adaptive immune system are special types of leukocytes, called lymphocytes. B cells and T cells are important types of lymphocytes and are derived from hematopoietic stem cells in the bone marrow. B cells are involved in the humoral immune response, whereas T cells are involved in cell-mediated immune response. The term "immune cell" includes immune effector cells.

As used herein the term "immune effector cell," refers to a cell that is involved in an immune response, e.g., in the promotion of an immune effector response. Examples of immune effector cells include, but are not limited to, T cells (e.g., alpha/beta T cells, gamma/delta T cells CD4+ T cells, CD8+ T cells), B cells, natural killer (NK) cells, natural killer T (NK T) cells, monocytes, macrophages, neutrophils, basophils, dendritic cells and mast cells.

The terms "effector function" or "effector response" refer to a specialized function of a cell. Effector function of a T cell, for example, may be cytolytic activity (e.g., CD8+ T cells) or helper activity (e.g., CD4+ T cells) including the secretion of cytokines.

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

The term, a "substantially purified cell" or "substantially purified cell population" refers to a cell or cell population that is essentially free of other cell types. A substantially purified cell also refers to a cell which has been separated from other cell types with which it is normally associated in its naturally occurring state. In some instances, a population of substantially purified cells refers to a homogenous population of cells. In other instances, this term refers simply to cell that have been separated from the cells with which they are naturally associated in their natural state. In some aspects, the cells are cultured in vitro. In other aspects, the cells are not cultured in vitro.

"Derived from" as that term is used herein, indicates a relationship between a first and a second molecule. It generally refers to structural similarity between the first molecule and a second molecule and does not connote or include a process or source limitation on a first molecule that is derived from a second molecule. For example, in the case of an intracellular signaling domain that is derived from a CD3zeta molecule, the intracellular signaling domain retains sufficient CD3zeta structure such that is has the required function, namely, the ability to generate a signal under the appropriate conditions. It does not connote or include a limitation to a particular process of producing the intracellular signaling domain, e.g., it does not mean that, to provide the intracellular signaling domain, one must start with a CD3zeta sequence and delete unwanted sequence, or impose mutations, to arrive at the intracellular signaling domain.

The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

Calculations of homology or sequence identity between sequences (the terms are used interchangeably herein) are performed as follows.

To determine the percent identity of two amino acid sequences, or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence aligned for comparison purposes is at least 30%, preferably at least 40%, more preferably at least 50%, 60%, and even more preferably at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology").

The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. In a preferred embodiment, the percent identity between two amino acid sequences is determined using the Needleman and Wunsch ((1970) *J. Mol. Biol.* 48:444-453) algorithm which has been incorporated into the GAP program in the GCG software package (available at gcg.com), using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package (available at gcg.com), using a NWSgapdna.CMP matrix and a gap weight of 40, 50, 60, 70, or 80 and a length weight of 1, 2, 3, 4, 5, or 6. A particularly preferred set of parameters (and the one that should be used unless otherwise specified) are a Blossum 62 scoring matrix with a gap penalty of 12, a gap extend penalty of 4, and a frameshift gap penalty of 5.

The percent identity between two amino acid or nucleotide sequences can be determined using the algorithm of E. Meyers and W. Miller ((1989) *CABIOS,* 4:11-17) which has been incorporated into the ALIGN program (version 2.0), using a PAM120 weight residue table, a gap length penalty of 12 and a gap penalty of 4.

The nucleic acid and protein sequences described herein can be used as a "query sequence" to perform a search against public databases to, for example, identify other family members or related sequences. Such searches can be performed using the NBLAST and XBLAST programs (version 2.0) of Altschul, et al. (1990) *J. Mol. Biol.* 215: 403-10. BLAST nucleotide searches can be performed with the NBLAST program, score=100, wordlength=12 to obtain nucleotide sequences homologous to a nucleic acid molecule of the invention. BLAST protein searches can be performed with the XBLAST program, score=50, wordlength=3 to obtain amino acid sequences homologous to protein molecules of the invention. To obtain gapped alignments for comparison purposes, Gapped BLAST can be utilized as described in Altschul et al., (1997) *Nucleic Acids Res.* 25:3389-3402. When utilizing BLAST and Gapped BLAST programs, the default parameters of the respective programs (e.g., XBLAST and NBLAST) can be used.

It is understood that the molecules of the present invention may have additional conservative or non-essential amino acid substitutions, which do not have a substantial effect on their functions.

The term "amino acid" is intended to embrace all molecules, whether natural or synthetic, which include both an amino functionality and an acid functionality and capable of being included in a polymer of naturally occurring amino acids. Exemplary amino acids include naturally occurring amino acids; analogs, derivatives and congeners thereof, amino acid analogs having variant side chains; and all stereoisomers of any of any of the foregoing. As used herein the term "amino acid" includes both the D- or L-optical isomers and peptidomimetics.

A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Such conservative modifications include amino acid substitutions, additions and deletions. Modifications can be introduced into an antibody or antibody fragment by standard techniques known in the art, such as site-directed mutagenesis and PCR-mediated mutagenesis. Conservative substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a CAR can be replaced with other amino acid residues from the same side chain family and the altered CAR can be tested using the functional assays described herein The terms "polypeptide", "peptide" and "protein" (if single chain) are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. The polypeptide can be isolated from natural sources, can be a produced by recombinant techniques from a eukaryotic or prokaryotic host, or can be a product of synthetic procedures.

The terms "nucleic acid," "nucleic acid sequence," "nucleotide sequence," or "polynucleotide sequence," and "polynucleotide" are used interchangeably. They refer to a polymeric form of nucleotides of any length, either deoxyribonucleotides or ribonucleotides, or analogs thereof. The polynucleotide may be either single-stranded or double-stranded, and if single-stranded may be the coding strand or non-coding (antisense) strand. A polynucleotide may comprise modified nucleotides, such as methylated nucleotides and nucleotide analogs. The sequence of nucleotides may be interrupted by non-nucleotide components. A polynucleotide may be further modified after polymerization, such as by conjugation with a labeling component. The nucleic acid may be a recombinant polynucleotide, or a polynucleotide of genomic, cDNA, semisynthetic, or synthetic origin which either does not occur in nature or is linked to another polynucleotide in a non-natural arrangement.

The term "isolated," as used herein, refers to material that is removed from its original or native environment (e.g., the natural environment if it is naturally occurring). For example, a naturally occurring polynucleotide or polypeptide present in a living animal is not isolated, but the same polynucleotide or polypeptide, separated by human intervention from some or all of the co-existing materials in the natural system, is isolated. Such polynucleotides could be part of a vector and/or such polynucleotides or polypeptides could be part of a composition, and still be isolated in that such vector or composition is not part of the environment in which it is found in nature.

The term "endogenous" refers to any material from or produced inside an organism, cell, tissue or system.

The term "exogenous" refers to any material introduced from or produced outside an organism, cell, tissue or system.

The term "expression" refers to the transcription and/or translation of a particular nucleotide sequence driven by a promoter.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

The term "vector" as used herein refers to any vehicle that can be used to deliver and/or express a nucleic acid molecule. It can be a transfer vector or an expression vector as described herein.

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector.

The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art.

The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

The term "parenteral" administration of an immunogenic composition includes, e.g., subcutaneous (s.c.), intravenous (i.v.), intramuscular (i.m.), or intrasternal injection, intratumoral, or infusion techniques.

The term "promoter" refers to a DNA sequence recognized by the synthetic machinery of the cell, or introduced synthetic machinery, required to initiate the specific transcription of a polynucleotide sequence.

The term "promoter/regulatory sequence" refers to a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue specific manner.

The term "constitutive promoter" refers to a nucleotide sequence which, when operably linked with a polynucleotide which encodes or specifies a gene product, causes the gene product to be produced in a cell under most or all physiological conditions of the cell.

The term "inducible promoter" refers to a nucleotide sequence which, when operably linked with a polynucleotide which encodes or specifies a gene product, causes the gene product to be produced in a cell substantially only when an inducer which corresponds to the promoter is present in the cell.

The term "tissue-specific promoter" refers to a nucleotide sequence which, when operably linked with a polynucleotide encodes or specified by a gene, causes the gene product to be produced in a cell substantially only if the cell is a cell of the tissue type corresponding to the promoter.

As used herein, "transient" refers to expression of a non-integrated transgene for a period of hours, days or weeks, wherein the period of time of expression is less than the period of time for expression of the gene if integrated into the genome or contained within a stable plasmid replicon in the host cell.

The term "transfected" or "transformed" or "transduced" refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

The term "chimeric antigen receptor" or alternatively a "CAR" are used interchangeably herein and refer to a recombinant polypeptide construct comprising at least an extracellular antigen binding domain, a transmembrane domain and a cytoplasmic signaling domain (also referred to herein as "an intracellular signaling domain") comprising a functional signaling domain derived from a stimulatory molecule as defined below. In some embodiments, the domains in the CAR polypeptide construct are in the same polypeptide chain, e.g., comprise a chimeric fusion protein. In some embodiments, the domains in the CAR polypeptide construct are not contiguous with each other, e.g., are in different polypeptide chains. In one aspect, the stimulatory molecule of the CAR is the zeta chain associated with the T cell receptor complex. In one aspect, the cytoplasmic signaling domain comprises a primary signaling domain (e.g., a primary signaling domain of CD3-zeta). In one aspect, the cytoplasmic signaling domain further comprises one or more functional signaling domains derived from at least one costimulatory molecule as defined below. In one aspect, the costimulatory molecule is chosen from 4-1BB (i.e., CD137), CD27, ICOS, and/or CD28. In one aspect, the CAR comprises a chimeric fusion protein comprising an extracellular antigen recognition domain, a transmembrane domain and an intracellular signaling domain comprising a functional signaling domain derived from a stimulatory molecule. In one aspect, the CAR comprises a chimeric fusion protein comprising an extracellular antigen recognition domain, a transmembrane domain and an intracellular signaling domain comprising a functional signaling domain derived from a co-stimulatory molecule and a functional signaling domain derived from a stimulatory molecule. In one aspect, the CAR comprises a chimeric fusion protein comprising an extracellular antigen recognition domain, a transmembrane domain and an intracellular signaling domain comprising two functional signaling domains derived from one or more co-stimulatory molecule(s) and a functional signaling domain derived from a stimulatory molecule. In one aspect, the CAR comprises a chimeric fusion protein comprising an extracellular antigen recognition domain, a transmembrane domain and an intracellular signaling domain comprising at least two functional signaling domains derived from one or more co-stimulatory molecule(s) and a functional signaling domain derived from a stimulatory molecule. In one aspect the CAR comprises an optional leader sequence at the amino-terminus (N-ter) of the CAR fusion protein. In one aspect, the CAR further comprises a leader sequence at the N-terminus of the extracellular antigen recognition domain, wherein the leader sequence is optionally cleaved from the antigen recognition domain (e.g., a scFv) during cellular processing and localization of the CAR to the cellular membrane.

The term "signaling domain" as used herein refers to the functional portion of a protein which acts by transmitting information within the cell to regulate cellular activity via defined signaling pathways by generating second messengers or functioning as effectors by responding to such messengers.

An "intracellular signaling domain," as the term is used herein, refers to an intracellular portion of a molecule. The intracellular signaling domain can generate a signal that promotes an immune effector function of the CAR containing cell, e.g., a CART cell or CAR-expressing NK cell. Examples of immune effector function, e.g., in a CART cell or CAR-expressing NK cell, include cytolytic activity and helper activity, including the secretion of cytokines. In embodiments, the intracellular signal domain transduces the effector function signal and directs the cell to perform a specialized function. While the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term intracellular signaling domain is thus meant to include any truncated portion of the intracellular signaling domain sufficient to transduce the effector function signal. In some embodiment, the intracellular signaling domain comprises a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation. For example, in the case of a CAR-expressing immune effector cell, e.g., CART cell or CAR-expressing NK cell, a primary intracellular signaling domain can comprise a cytoplasmic sequence of a T cell receptor, and a costimulatory intracellular signaling domain can comprise cytoplasmic sequence from co-receptor or costimulatory molecule. A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, FcR gamma, FcR beta, CD3 gamma, CD3 delta, CD3 epsilon, CDS, CD22, CD79a, CD79b, CD278 ("ICOS"), FcεRI, CD66d, DAP10, and DAP12.

The term "zeta" or alternatively "zeta chain", "CD3-zeta" or "TCR-zeta" is defined as the protein provided as GenBan Acc. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain that are sufficient to functionally transmit an initial signal necessary for T cell activation. In one aspect the cytoplasmic domain of zeta comprises residues 52 through 164 of GenBank Acc. No. BAG36664.1 or the equivalent residues from a non-human species, e.g., mouse, rodent, monkey, ape and the like, that are functional orthologs thereof.

The term "costimulatory molecule" refers to the cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that are required for an efficient immune response. Costimulatory molecules include, but are not limited to an a MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, $V_LA1$, CD49a, ITGA4, IA4, CD49D, ITGA6, $V_LA$-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

A "costimulatory intracellular signaling domain" refers to the intracellular portion of a costimulatory molecule. The intracellular signaling domain can comprise the entire intracellular portion, or the entire native intracellular signaling domain, of the molecule from which it is derived, or a functional fragment thereof.

The term "signal transduction pathway" as used herein refers to the biochemical relationship between a variety of signal transduction molecules that play a role in the transmission of a signal from one portion of a cell to another portion of a cell.

The term "cell surface receptor" as used herein includes molecules and complexes of molecules capable of receiving a signal and transmitting signal across the membrane of a cell.

The term "anti-tumor effect" or "anti-cancer effect," used interchangeably herein refer to a biological effect which can be manifested by various means, including but not limited to, e.g., a decrease in tumor volume, a decrease in the number of tumor cells, a decrease in the number of metastases, an increase in life expectancy, decrease in tumor cell proliferation, decrease in tumor cell survival, or amelioration of various physiological symptoms associated with the cancerous condition. An "anti-tumor effect" can also be manifested by the ability of the peptides, polynucleotides, cells and antibodies in prevention of the occurrence of tumor in the first place.

The terms "Cancer" or "tumor" as used interchangeably herein and encompass all types of oncogenic processes and/or cancerous growths. In embodiments, cancer includes primary tumors as well as metastatic tissues or malignantly transformed cells, tissues, or organs. In embodiments, cancer encompasses all histopathologies and stages, e.g., stages of invasiveness/severity, of a cancer. In embodiments, cancer includes relapsed and/or resistant cancer. For example, both terms encompass solid and liquid tumors. As used herein, the term cancer includes premalignant, as well as malignant cancers and tumors.

The term "autologous" refers to any material derived from the same individual to whom it is later to be re-introduced into the individual.

The term "allogeneic" refers to any material derived from a different animal of the same species as the individual to whom the material is introduced. Two or more individuals are said to be allogeneic to one another when the genes at one or more loci are not identical. In some aspects, allogeneic material from individuals of the same species may be sufficiently unlike genetically to interact antigenically.

The term "xenogeneic" refers to a graft derived from an animal of a different species.

The term "apheresis" as used herein refers to the art-recognized extracorporeal process by which the blood of a donor or patient is removed from the donor or patient and passed through an apparatus that separates out selected particular constituent(s) and returns the remainder to the circulation of the donor or patient, e.g., by re-transfusion. Thus, in the context of "an apheresis sample" refers to a sample obtained using apheresis.

The term "combination" refers to either a fixed combination in one dosage unit form, or a combined administration where a compound and a combination partner (e.g. another drug as explained below, also referred to as "therapeutic agent" or "co-agent") may be administered independently at the same time or separately within time intervals, especially where these time intervals allow that the combination partners show a cooperative, e.g. synergistic effect. The single components may be packaged in a kit or separately. One or both of the components (e.g., powders or liquids) may be reconstituted or diluted to a desired dose prior to administration. The terms "co-administration" or "combined administration" or the like as utilized herein are meant to encompass administration of the selected combination partner to a single subject in need thereof (e.g. a patient), and are intended to include treatment regimens in which the agents are not necessarily administered by the same route of administration or at the same time. The term "pharmaceutical combination" as used herein means a product that results from the mixing or combining of more than one active ingredient and includes both fixed and non-fixed combinations of the active ingredients. The term "fixed combination" means that the active ingredients, e.g. a compound and a combination partner, are both administered to a patient simultaneously in the form of a single entity or dosage. The term "non-fixed combination" means that the active ingredients, e.g. a compound and a combination partner, are both administered to a patient as separate entities either simultaneously, concurrently or sequentially with no specific time limits, wherein such administration provides therapeutically effective levels of the two compounds in the body of the patient. The latter also applies to cocktail therapy, e.g. the administration of three or more active ingredients.

The term "effective amount" or "therapeutically effective amount" are used interchangeably herein, and refer to an amount of a compound, formulation, material, or composition, as described herein effective to achieve a particular biological result.

As used herein, the terms "treat," "treatment," and "treating" refer to the reduction or amelioration of the progression, severity and/or duration of a proliferative disorder, or the amelioration of one or more symptoms (preferably, one or more discernible symptoms) of a proliferative disorder resulting from the administration of one or more therapies (e.g., one or more therapeutic agents such as a CAR). In specific embodiments, the terms "treat," "treatment," and "treating" refer to the amelioration of at least one measurable physical parameter of a proliferative disorder, such as growth of a tumor, not necessarily discernible by the patient. In other embodiments the terms "treat", "treatment" and "treating"-refer to the inhibition of the progression of a proliferative disorder, either physically by, e.g., stabilization of a discernible symptom, physiologically by, e.g., stabilization of a physical parameter, or both. In other embodiments the terms "treat," "treatment," and "treating" refer to the reduction or stabilization of tumor size or cancerous cell count.

The term "therapeutic" as used herein means a treatment. A therapeutic effect is obtained by reduction, suppression, remission, or eradication of a disease state.

The term "prophylaxis" as used herein means the prevention of or protective treatment for a disease or disease state.

The term "subject" is intended to include living organisms in which an immune response can be elicited (e.g., mammals, human).

Various aspects of the invention are described in further detail below. Additional definitions are set out throughout the specification.

Antibody Molecules

In one embodiment, the antibody molecule binds to a cancer antigen, e.g., a tumor antigen or a stromal antigen. In some embodiments, the cancer antigen is, e.g., a mammalian, e.g., a human, cancer antigen. In other embodiments, the antibody molecule binds to an immune cell antigen, e.g., a mammalian, e.g., a human, immune cell antigen. For example, the antibody molecule binds specifically to an epitope, e.g., linear or conformational epitope, on the cancer antigen or the immune cell antigen.

In an embodiment, an antibody molecule is a monospecific antibody molecule and binds a single epitope. E.g., a monospecific antibody molecule having a plurality of immunoglobulin variable domain sequences, each of which binds the same epitope.

In an embodiment an antibody molecule is a multispecific or multifunctional antibody molecule, e.g., it comprises a plurality of immunoglobulin variable domains sequences, wherein a first immunoglobulin variable domain sequence of the plurality has binding specificity for a first epitope and a second immunoglobulin variable domain sequence of the plurality has binding specificity for a second epitope. In an embodiment the first and second epitopes are on the same antigen, e.g., the same protein (or subunit of a multimeric protein). In an embodiment the first and second epitopes overlap. In an embodiment the first and second epitopes do not overlap. In an embodiment the first and second epitopes are on different antigens, e.g., the different proteins (or different subunits of a multimeric protein). In an embodiment a multispecific antibody molecule comprises a third, fourth or fifth immunoglobulin variable domain. In an embodiment, a multispecific antibody molecule is a bispecific antibody molecule, a trispecific antibody molecule, or a tetraspecific antibody molecule.

In an embodiment a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope. In an embodiment the first and second epitopes are on the same antigen, e.g., the same protein (or subunit of a multimeric protein). In an embodiment the first and second epitopes overlap. In an embodiment the first and second epitopes do not overlap. In an embodiment the first and second epitopes are on different antigens, e.g., the different proteins (or different subunits of a multimeric protein). In an embodiment a bispecific antibody molecule comprises a heavy chain variable domain sequence and a light chain variable domain sequence which have binding specificity for a first epitope and a heavy chain variable domain sequence and a light chain variable domain sequence which have binding specificity for a second epitope. In an embodiment a bispecific antibody molecule comprises a half antibody having binding specificity for a first epitope and a half antibody having binding specificity for a second epitope. In an embodiment a bispecific antibody molecule comprises a half antibody, or fragment thereof, having binding specificity for a first epitope and a half antibody, or fragment thereof, having binding specificity for a second epitope. In an embodiment a bispecific antibody molecule comprises a scFv or a Fab, or fragment thereof, have binding specificity for a first epitope and a scFv or a Fab, or fragment thereof, have binding specificity for a second epitope.

In an embodiment, an antibody molecule comprises a diabody, and a single-chain molecule, as well as an antigen-binding fragment of an antibody (e.g., Fab, $F(ab')_2$, and Fv). For example, an antibody molecule can include a heavy (H) chain variable domain sequence (abbreviated herein as VH), and a light (L) chain variable domain sequence (abbreviated herein as VL). In an embodiment an antibody molecule comprises or consists of a heavy chain and a light chain (referred to herein as a half antibody. In another example, an antibody molecule includes two heavy (H) chain variable domain sequences and two light (L) chain variable domain sequence, thereby forming two antigen binding sites, such as Fab, Fab', $F(ab')_2$, Fc, Fd, Fd', Fv, single chain antibodies (scFv for example), single variable domain antibodies, diabodies (Dab) (bivalent and bispecific), and chimeric (e.g., humanized) antibodies, which may be produced by the modification of whole antibodies or those synthesized de novo using recombinant DNA technologies. These functional antibody fragments retain the ability to selectively bind with their respective antigen or receptor. Antibodies and antibody fragments can be from any class of antibodies including, but not limited to, IgG, IgA, IgM, IgD, and IgE, and from any subclass (e.g., IgG1, IgG2, IgG3, and IgG4) of antibodies. A preparation of antibody molecules can be monoclonal or polyclonal. An antibody molecule can also be a human, humanized, CDR-grafted, or in vitro generated antibody. The antibody can have a heavy chain constant region chosen from, e.g., IgG1, IgG2, IgG3, or IgG4. The antibody can also have a light chain chosen from, e.g., kappa or lambda. The term "immunoglobulin" (Ig) is used interchangeably with the term "antibody" herein.

Examples of antigen-binding fragments of an antibody molecule include: (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a diabody (dAb) fragment, which consists of a VH domain; (vi) a camelid or camelized variable domain; (vii) a single chain Fv (scFv), see e.g., Bird et al. (1988) *Science* 242:423-426; and Huston et al. (1988) *Proc. Natl. Acad. Sci. USA* 85:5879-5883); (viii) a single domain antibody. These antibody fragments are obtained using conventional techniques known to those with skill in the art, and the fragments are screened for utility in the same manner as are intact antibodies.

Antibody molecules include intact molecules as well as functional fragments thereof. Constant regions of the antibody molecules can be altered, e.g., mutated, to modify the properties of the antibody (e.g., to increase or decrease one or more of: Fc receptor binding, antibody glycosylation, the number of cysteine residues, effector cell function, or complement function).

Antibody molecules can also be single domain antibodies. Single domain antibodies can include antibodies whose complementary determining regions are part of a single domain polypeptide. Examples include, but are not limited to, heavy chain antibodies, antibodies naturally devoid of light chains, single domain antibodies derived from conventional 4-chain antibodies, engineered antibodies and single domain scaffolds other than those derived from antibodies. Single domain antibodies may be any of the art, or any future single domain antibodies. Single domain antibodies may be derived from any species including, but not limited to mouse, human, camel, llama, fish, shark, goat, rabbit, and bovine. According to another aspect of the invention, a single domain antibody is a naturally occurring single domain antibody known as heavy chain antibody devoid of light chains. Such single domain antibodies are disclosed in WO 9404678, for example. For clarity reasons, this variable domain derived from a heavy chain antibody naturally devoid of light chain is known herein as a VHH or nanobody to distinguish it from the conventional VH of four chain immunoglobulins. Such a VHH molecule can be derived from antibodies raised in Camelidae species, for example in camel, llama, dromedary, alpaca and guanaco. Other species besides Camelidae may produce heavy chain antibodies naturally devoid of light chain; such VHHs are within the scope of the invention.

The VH and VL regions can be subdivided into regions of hypervariability, termed "complementarity determining regions" (CDR), interspersed with regions that are more conserved, termed "framework regions" (FR or FW).

The extent of the framework region and CDRs has been precisely defined by a number of methods (see, Kabat, E. A., et al. (1991) Sequences of Proteins of Immunological Interest, Fifth Edition, U.S. Department of Health and Human Services, NIH Publication No. 91-3242; Chothia, C. et al. (1987) *J. Mol. Biol.* 196:901-917; and the AbM definition used by Oxford Molecular's AbM antibody modeling software. See, generally, e.g., *Protein Sequence and Structure Analysis of Antibody Variable Domains*. In: Antibody Engineering Lab Manual (Ed.: Duebel, S. and Kontermann, R., Springer-Verlag, Heidelberg).

The terms "complementarity determining region," and "CDR," as used herein refer to the sequences of amino acids within antibody variable regions which confer antigen specificity and binding affinity. In general, there are three CDRs in each heavy chain variable region (HCDR1, HCDR2, HCDR3) and three CDRs in each light chain variable region (LCDR1, LCDR2, LCDR3).

The precise amino acid sequence boundaries of a given CDR can be determined using any of a number of known schemes, including those described by Kabat et al. (1991), "Sequences of Proteins of Immunological Interest," 5th Ed. Public Health Service, National Institutes of Health, Bethesda, MD ("Kabat" numbering scheme), Al-Lazikani et al., (1997) *JMB* 273, 927-948 ("Chothia" numbering scheme). As used herein, the CDRs defined according the "Chothia" number scheme are also sometimes referred to as "hypervariable loops."

For example, under Kabat, the CDR amino acid residues in the heavy chain variable domain (VH) are numbered 31-35 (HCDR1), 50-65 (HCDR2), and 95-102 (HCDR3); and the CDR amino acid residues in the light chain variable domain (VL) are numbered 24-34 (LCDR1), 50-56 (LCDR2), and 89-97 (LCDR3). Under Chothia, the CDR amino acids in the VH are numbered 26-32 (HCDR1), 52-56 (HCDR2), and 95-102 (HCDR3); and the amino acid residues in VL are numbered 26-32 (LCDR1), 50-52 (LCDR2), and 91-96 (LCDR3).

Each VH and VL typically includes three CDRs and four FRs, arranged from amino-terminus to carboxy-terminus in the following order: FR1, CDR1, FR2, CDR2, FR3, CDR3, FR4.

The antibody molecule can be a polyclonal or a monoclonal antibody.

The terms "monoclonal antibody" or "monoclonal antibody composition" as used herein refer to a preparation of antibody molecules of single molecular composition. A monoclonal antibody composition displays a single binding specificity and affinity for a particular epitope. A monoclonal antibody can be made by hybridoma technology or by methods that do not use hybridoma technology (e.g., recombinant methods).

The antibody can be recombinantly produced, e.g., produced by phage display or by combinatorial methods.

Phage display and combinatorial methods for generating antibodies are known in the art (as described in, e.g., Ladner et al. U.S. Pat. No. 5,223,409; Kang et al. International Publication No. WO 92/18619; Dower et al. International Publication No. WO 91/17271; Winter et al. International Publication WO 92/20791; Markland et al. International Publication No. WO 92/15679; Breitling et al. International Publication WO 93/01288; McCafferty et al. International Publication No. WO 92/01047; Garrard et al. International Publication No. WO 92/09690; Ladner et al. International Publication No. WO 90/02809; Fuchs et al. (1991) *Bio/Technology* 9:1370-1372; Hay et al. (1992) *Hum Antibod Hybridomas* 3:81-85; Huse et al. (1989) *Science* 246:1275-1281; Griffiths et al. (1993) *EMBO J* 12:725-734; Hawkins et al. (1992) *J Mol Biol* 226:889-896; Clackson et al. (1991) *Nature* 352:624-628; Gram et al. (1992) *PNAS* 89:3576-3580; Garrad et al. (1991) *Bio/Technology* 9:1373-1377; Hoogenboom et al. (1991) *Nuc Acid Res* 19:4133-4137; and Barbas et al. (1991) *PNAS* 88:7978-7982, the contents of all of which are incorporated by reference herein).

In one embodiment, the antibody is a fully human antibody (e.g., an antibody made in a mouse which has been genetically engineered to produce an antibody from a human immunoglobulin sequence), or a non-human antibody, e.g., a rodent (mouse or rat), goat, primate (e.g., monkey), camel antibody. Preferably, the non-human antibody is a rodent (mouse or rat antibody). Methods of producing rodent antibodies are known in the art.

Human monoclonal antibodies can be generated using transgenic mice carrying the human immunoglobulin genes rather than the mouse system. Splenocytes from these transgenic mice immunized with the antigen of interest are used to produce hybridomas that secrete human mAbs with specific affinities for epitopes from a human protein (see, e.g., Wood et al. International Application WO 91/00906, Kucherlapati et al. PCT publication WO 91/10741; Lonberg et al. International Application WO 92/03918; Kay et al. International Application 92/03917; Lonberg, N. et al. 1994 *Nature* 368:856-859; Green, L. L. et al. 1994 *Nature Genet.* 7:13-21; Morrison, S. L. et al. 1994 *Proc. Natl. Acad. Sci. USA* 81:6851-6855; Bruggeman et al. 1993 *Year Immunol* 7:33-40; Tuaillon et al. 1993 *PNAS* 90:3720-3724; Bruggeman et al. 1991 *Eur J Immunol* 21:1323-1326).

An antibody molecule can be one in which the variable region, or a portion thereof, e.g., the CDRs, are generated in a non-human organism, e.g., a rat or mouse. Chimeric, CDR-grafted, and humanized antibodies are within the invention. Antibody molecules generated in a non-human organism, e.g., a rat or mouse, and then modified, e.g., in the variable framework or constant region, to decrease antigenicity in a human are within the invention.

An "effectively human" protein is a protein that does substantially not evoke a neutralizing antibody response, e.g., the human anti-murine antibody (HAMA) response. HAMA can be problematic in a number of circumstances, e.g., if the antibody molecule is administered repeatedly, e.g., in treatment of a chronic or recurrent disease condition. A HAMA response can make repeated antibody administration potentially ineffective because of an increased antibody clearance from the serum (see, e.g., Saleh et al., *Cancer Immunol. Immunother.*, 32:180-190 (1990)) and also because of potential allergic reactions (see, e.g., LoBuglio et al., *Hybridoma,* 5:5117-5123 (1986)).

Chimeric antibodies can be produced by recombinant DNA techniques known in the art (see Robinson et al., International Patent Publication PCT/US86/02269; Akira, et al., European Patent Application 184,187; Taniguchi, M., European Patent Application 171,496; Morrison et al., European Patent Application 173,494; Neuberger et al., International Application WO 86/01533; Cabilly et al. U.S. Pat. No. 4,816,567; Cabilly et al., European Patent Application 125,023; Better et al. (1988 *Science* 240:1041-1043); Liu et al. (1987) *PNAS* 84:3439-3443; Liu et al., 1987, *J. Immunol.* 139:3521-3526; Sun et al. (1987) PNAS 84:214-218; Nishimura et al., 1987, *Canc. Res.* 47:999-1005; Wood et al. (1985) *Nature* 314:446-449; and Shaw et al., 1988, *J. Natl Cancer Inst.* 80:1553-1559).

A humanized or CDR-grafted antibody will have at least one or two but generally all three recipient CDRs (of heavy and or light immuoglobulin chains) replaced with a donor CDR. The antibody may be replaced with at least a portion of a non-human CDR or only some of the CDRs may be replaced with non-human CDRs. It is only necessary to replace the number of CDRs required for binding to the antigen. Preferably, the donor will be a rodent antibody, e.g., a rat or mouse antibody, and the recipient will be a human framework or a human consensus framework. Typically, the immunoglobulin providing the CDRs is called the "donor" and the immunoglobulin providing the framework is called the "acceptor." In one embodiment, the donor immunoglobulin is a non-human (e.g., rodent). The acceptor framework is a naturally occurring (e.g., a human) framework or a consensus framework, or a sequence about 85% or higher, preferably 90%, 95%, 99% or higher identical thereto.

As used herein, the term "consensus sequence" refers to the sequence formed from the most frequently occurring amino acids (or nucleotides) in a family of related sequences (See e.g., Winnaker, From Genes to Clones (Verlagsgesellschaft, Weinheim, Germany 1987). In a family of proteins, each position in the consensus sequence is occupied by the amino acid occurring most frequently at that position in the family. If two amino acids occur equally frequently, either can be included in the consensus sequence. A "consensus framework" refers to the framework region in the consensus immunoglobulin sequence.

An antibody molecule can be humanized by methods known in the art (see e.g., Morrison, S. L., 1985, *Science* 229:1202-1207, by Oi et al., 1986, *BioTechniques* 4:214, and by Queen et al. U.S. Pat. Nos. 5,585,089, 5,693,761 and 5,693,762, the contents of all of which are hereby incorporated by reference).

Humanized or CDR-grafted antibody molecules can be produced by CDR-grafting or CDR substitution, wherein one, two, or all CDRs of an immunoglobulin chain can be replaced. See e.g., U.S. Pat. No. 5,225,539; Jones et al. 1986 *Nature* 321:552-525; Verhoeyan et al. 1988 *Science* 239:1534; Beidler et al. 1988 *J. Immunol.* 141:4053-4060; Winter U.S. Pat. No. 5,225,539, the contents of all of which are hereby expressly incorporated by reference. Winter describes a CDR-grafting method which may be used to prepare the humanized antibodies of the present invention (UK Patent Application GB 2188638A, filed on Mar. 26, 1987; Winter U.S. Pat. No. 5,225,539), the contents of which is expressly incorporated by reference.

Also within the scope of the invention are humanized antibody molecules in which specific amino acids have been substituted, deleted or added. Criteria for selecting amino acids from the donor are described in U.S. Pat. No. 5,585,089, e.g., columns 12-16 of U.S. Pat. No. 5,585,089, e.g., columns 12-16 of U.S. Pat. No. 5,585,089, the contents of which are hereby incorporated by reference. Other techniques for humanizing antibodies are described in Padlan et al. EP 519596 A1, published on Dec. 23, 1992.

The antibody molecule can be a single chain antibody. A single-chain antibody (scFV) may be engineered (see, for example, Colcher, D. et al. (1999) *Ann N Y Acad Sci* 880:263-80; and Reiter, Y. (1996) *Clin Cancer Res* 2:245-52). The single chain antibody can be dimerized or multimerized to generate multivalent antibodies having specificities for different epitopes of the same target protein.

In yet other embodiments, the antibody molecule has a heavy chain constant region chosen from, e.g., the heavy chain constant regions of IgG1, IgG2, IgG3, IgG4, IgM, IgA1, IgA2, IgD, and IgE; particularly, chosen from, e.g., the (e.g., human) heavy chain constant regions of IgG1, IgG2, IgG3, and IgG4. In another embodiment, the antibody molecule has a light chain constant region chosen from, e.g., the (e.g., human) light chain constant regions of kappa or lambda. The constant region can be altered, e.g., mutated, to modify the properties of the antibody (e.g., to increase or decrease one or more of: Fc receptor binding, antibody glycosylation, the number of cysteine residues, effector cell function, and/or complement function). In one embodiment the antibody has: effector function; and can fix complement. In other embodiments the antibody does not; recruit effector cells; or fix complement. In another embodiment, the antibody has reduced or no ability to bind an Fc receptor. For example, it is a isotype or subtype, fragment or other mutant, which does not support binding to an Fc receptor, e.g., it has a mutagenized or deleted Fc receptor binding region.

Methods for altering an antibody constant region are known in the art. Antibodies with altered function, e.g. altered affinity for an effector ligand, such as FcR on a cell, or the C1 component of complement can be produced by replacing at least one amino acid residue in the constant portion of the antibody with a different residue (see e.g., EP 388,151 A1, U.S. Pat. Nos. 5,624,821 and 5,648,260, the contents of all of which are hereby incorporated by reference). Similar type of alterations could be described which if applied to the murine, or other species immunoglobulin would reduce or eliminate these functions.

An antibody molecule can be derivatized or linked to another functional molecule (e.g., another peptide or protein). As used herein, a "derivatized" antibody molecule is one that has been modified. Methods of derivatization include but are not limited to the addition of a fluorescent moiety, a radionucleotide, a toxin, an enzyme or an affinity ligand such as biotin. Accordingly, the antibody molecules of the invention are intended to include derivatized and otherwise modified forms of the antibodies described herein, including immunoadhesion molecules. For example, an antibody molecule can be functionally linked (by chemical coupling, genetic fusion, noncovalent association or otherwise) to one or more other molecular entities, such as another antibody (e.g., a bispecific antibody or a diabody), a detectable agent, a cytotoxic agent, a pharmaceutical agent, and/or a protein or peptide that can mediate association of the antibody or antibody portion with another molecule (such as a streptavidin core region or a polyhistidine tag).

One type of derivatized antibody molecule is produced by crosslinking two or more antibodies (of the same type or of different types, e.g., to create bispecific antibodies). Suitable crosslinkers include those that are heterobifunctional, having two distinctly reactive groups separated by an appropriate spacer (e.g., m-maleimidobenzoyl-N-hydroxysuccinimide ester) or homobifunctional (e.g., disuccinimidyl suberate). Such linkers are available from Pierce Chemical Company, Rockford, Ill.

Multispecific or Multifunctional Antibody Molecules

Exemplary structures of multispecific and multifunctional molecules defined herein are described throughout. Exemplary structures are further described in: Weidle U et al. (2013) The Intriguing Options of Multispecific Antibody Formats for Treatment of Cancer. *Cancer Genomics & Proteomics* 10: 1-18 (2013); and Spiess C et al. (2015) Alternative molecular formats and therapeutic applications for bispecific antibodies. *Molecular Immunology* 67: 95-106; the full contents of each of which is incorporated by reference herein).

In embodiments, multispecific antibody molecules can comprise more than one antigen-binding site, where different sites are specific for different antigens. In embodiments, multispecific antibody molecules can bind more than one (e.g., two or more) epitopes on the same antigen. In embodiments, multispecific antibody molecules comprise an antigen-binding site specific for a target cell (e.g., cancer cell) and a different antigen-binding site specific for an immune effector cell. In one embodiment, the multispecific antibody molecule is a bispecific antibody molecule. Bispecific antibody molecules can be classified into five different structural groups: (i) bispecific immunoglobulin G (BsIgG); (ii) IgG appended with an additional antigen-binding moiety; (iii) bispecific antibody fragments; (iv) bispecific fusion proteins; and (v) bispecific antibody conjugates.

BsIgG is a format that is monovalent for each antigen. Exemplary BsIgG formats include but are not limited to crossMab, DAF (two-in-one), DAF (four-in-one), DutaMab, DT-IgG, knobs-in-holes common LC, knobs-in-holes assembly, charge pair, Fab-arm exchange, SEEDbody, triomab, LUZ-Y, Fcab, κλ-body, orthogonal Fab. See Spiess et al. Mol. Immunol. 67(2015):95-106. Exemplary BsIgGs include catumaxomab (Fresenius Biotech, Trion Pharma, Neopharm), which contains an anti-CD3 arm and an anti-EpCAM arm; and ertumaxomab (Neovii Biotech, Fresenius Biotech), which targets CD3 and HER2. In some embodiments, BsIgG comprises heavy chains that are engineered for heterodimerization. For example, heavy chains can be engineered for heterodimerization using a "knobs-into-holes" strategy, a SEED platform, a common heavy chain (e.g., in κλ-bodies), and use of heterodimeric Fc regions. See Spiess et al. Mol. Immunol. 67(2015):95-106. Strategies that have been used to avoid heavy chain pairing of homodimers in BsIgG include knobs-in-holes, duobody, azymetric, charge pair, HA-TF, SEEDbody, and differential protein A affinity. See Id. BsIgG can be produced by separate expression of the component antibodies in different host cells and subsequent purification/assembly into a BsIgG. BsIgG can also be produced by expression of the component antibodies in a single host cell. BsIgG can be purified using affinity chromatography, e.g., using protein A and sequential pH elution.

IgG appended with an additional antigen-binding moiety is another format of bispecific antibody molecules. For example, monospecific IgG can be engineered to have bispecificity by appending an additional antigen-binding unit onto the monospecific IgG, e.g., at the N- or C-terminus of either the heavy or light chain. Exemplary additional antigen-binding units include single domain antibodies (e.g., variable heavy chain or variable light chain), engineered protein scaffolds, and paired antibody variable domains (e.g., single chain variable fragments or variable fragments). See Id. Examples of appended IgG formats include dual variable domain IgG (DVD-Ig), IgG(H)-scFv, scFv-(H)IgG, IgG(L)-scFv, scFv-(L)IgG, IgG(L,H)-Fv, IgG(H)-V, V(H)-IgG, IgG(L)-V, V(L)-IgG, KIH IgG-scFab, 2scFv-IgG, IgG-2scFv, scFv4-Ig, zybody, and DVI-IgG (four-in-one). See Spiess et al. Mol. Immunol. 67(2015):95-106. An example of an IgG-scFv is MM-141 (Merrimack Pharmaceuticals), which binds IGF-1R and HER3. Examples of DVD-Ig include ABT-981 (AbbVie), which binds IL-1α and IL-1β; and ABT-122 (AbbVie), which binds TNF and IL-17A.

Bispecific antibody fragments (BsAb) are a format of bispecific antibody molecules that lack some or all of the antibody constant domains. For example, some BsAb lack an Fc region. In embodiments, bispecific antibody fragments include heavy and light chain regions that are connected by a peptide linker that permits efficient expression of the BsAb in a single host cell. Exemplary bispecific antibody fragments include but are not limited to nanobody, nanobody-HAS, BiTE, Diabody, DART, TandAb, scDiabody, scDiabody-CH3, Diabody-CH3, triple body, miniantibody, minibody, TriBi minibody, scFv-CH3 KIH, Fab-scFv, scFv-CH-CL-scFv, F(ab')2, F(ab')2-scFv2, scFv-KIH, Fab-scFv-Fc, tetravalent HCAb, scDiabody-Fc, Diabody-Fc, tandem scFv-Fc, and intrabody. See Id. For example, the BiTE format comprises tandem scFvs, where the component scFvs bind to CD3 on T cells and a surface antigen on cancer cells Bispecific fusion proteins include antibody fragments linked to other proteins, e.g., to add additional specificity and/or functionality. An example of a bispecific fusion protein is an immTAC, which comprises an anti-CD3 scFv linked to an affinity-matured T-cell receptor that recognizes HLA-presented peptides. In embodiments, the dock-and-lock (DNL) method can be used to generate bispecific antibody molecules with higher valency. Also, fusions to albumin binding proteins or human serum albumin can be extend the serum half-life of antibody fragments. See Id.

In embodiments, chemical conjugation, e.g., chemical conjugation of antibodies and/or antibody fragments, can be used to create BsAb molecules. See Id. An exemplary bispecific antibody conjugate includes the CovX-body format, in which a low molecular weight drug is conjugated site-specifically to a single reactive lysine in each Fab arm or an antibody or fragment thereof. In embodiments, the conjugation improves the serum half-life of the low molecular weight drug. An exemplary CovX-body is CVX-241 (NCT01004822), which comprises an antibody conjugated to two short peptides inhibiting either VEGF or Ang2. See Id.

The antibody molecules can be produced by recombinant expression, e.g., of at least one or more component, in a host system. Exemplary host systems include eukaryotic cells (e.g., mammalian cells, e.g., CHO cells, or insect cells, e.g., SF9 or S2 cells) and prokaryotic cells (e.g., *E. coli*). Bispecific antibody molecules can be produced by separate expression of the components in different host cells and subsequent purification/assembly. Alternatively, the antibody molecules can be produced by expression of the components in a single host cell. Purification of bispecific antibody molecules can be performed by various methods such as affinity chromatography, e.g., using protein A and sequential pH elution. In other embodiments, affinity tags can be used for purification, e.g., histidine-containing tag, myc tag, or streptavidin tag.

CDR-Grafted Scaffolds

In embodiments, the antibody molecule is a CDR-grafted scaffold domain. In embodiments, the scaffold domain is based on a fibronectin domain, e.g., fibronectin type III domain. The overall fold of the fibronectin type III (Fn3) domain is closely related to that of the smallest functional antibody fragment, the variable domain of the antibody heavy chain. There are three loops at the end of Fn3; the positions of BC, DE and FG loops approximately correspond to those of CDR1, 2 and 3 of the $V_H$ domain of an antibody. Fn3 does not have disulfide bonds; and therefore Fn3 is stable under reducing conditions, unlike antibodies and their fragments (see, e.g., WO 98/56915; WO 01/64942; WO 00/34784). An Fn3 domain can be modified (e.g., using CDRs or hypervariable loops described herein) or varied, e.g., to select domains that bind to an antigen/marker/cell described herein.

In embodiments, a scaffold domain, e.g., a folded domain, is based on an antibody, e.g., a "minibody" scaffold created by deleting three beta strands from a heavy chain variable domain of a monoclonal antibody (see, e.g., Tramontano et al., 1994, J Mol. Recognit. 7:9; and Martin et al., 1994, EMBO J. 13:5303-5309). The "minibody" can be used to present two hypervariable loops. In embodiments, the scaffold domain is a V-like domain (see, e.g., Coia et al. WO 99/45110) or a domain derived from tendamistatin, which is a 74 residue, six-strand beta sheet sandwich held together by two disulfide bonds (see, e.g., McConnell and Hoess, 1995, J Mol. Biol. 250:460). For example, the loops of tendamistatin can be modified (e.g., using CDRs or hypervariable loops) or varied, e.g., to select domains that bind to a marker/antigen/cell described herein. Another exemplary scaffold domain is a beta-sandwich structure derived from the extracellular domain of CTLA-4 (see, e.g., WO 00/60070).

Other exemplary scaffold domains include but are not limited to T-cell receptors; MHC proteins; extracellular domains (e.g., fibronectin Type III repeats, EGF repeats); protease inhibitors (e.g., Kunitz domains, ecotin, BPTI, and so forth); TPR repeats; trifoil structures; zinc finger domains; DNA-binding proteins; particularly monomeric DNA binding proteins; RNA binding proteins; enzymes, e.g., proteases (particularly inactivated proteases), RNase; chaperones, e.g., thioredoxin, and heat shock proteins; and intracellular signaling domains (such as SH2 and SH3 domains). See, e.g., US 20040009530 and U.S. Pat. No. 7,501,121, incorporated herein by reference.

In embodiments, a scaffold domain is evaluated and chosen, e.g., by one or more of the following criteria: (1) amino acid sequence, (2) sequences of several homologous domains, (3) 3-dimensional structure, and/or (4) stability data over a range of pH, temperature, salinity, organic solvent, oxidant concentration. In embodiments, the scaffold domain is a small, stable protein domain, e.g., a protein of less than 100, 70, 50, 40 or 30 amino acids. The domain may include one or more disulfide bonds or may chelate a metal, e.g., zinc.

Antibody-Based Fusions

A variety of formats can be generated which contain additional binding entities attached to the N or C terminus of antibodies. These fusions with single chain or disulfide stabilized Fvs or Fabs result in the generation of tetravalent molecules with bivalent binding specificity for each antigen. Combinations of scFvs and scFabs with IgGs enable the production of molecules which can recognize three or more different antigens.

Antibody-Fab Fusion

Antibody-Fab fusions are bispecific antibodies comprising a traditional antibody to a first target and a Fab to a second target fused to the C terminus of the antibody heavy chain. Commonly the antibody and the Fab will have a common light chain. Antibody fusions can be produced by (1) engineering the DNA sequence of the target fusion, and (2) transfecting the target DNA into a suitable host cell to express the fusion protein. It seems like the antibody-scFv fusion may be linked by a (Gly)-Ser linker between the C-terminus of the CH3 domain and the N-terminus of the scFv, as described by Coloma, J. et al. (1997) *Nature Biotech* 15:159.

Antibody-scFv Fusion

Antibody-scFv Fusions are bispecific antibodies comprising a traditional antibody and a scFv of unique specificity fused to the C terminus of the antibody heavy chain. The scFv can be fused to the C terminus through the Heavy Chain of the scFv either directly or through a linker peptide. Antibody fusions can be produced by (1) engineering the DNA sequence of the target fusion, and (2) transfecting the target DNA into a suitable host cell to express the fusion protein. It seems like the antibody-scFv fusion may be linked by a (Gly)-Ser linker between the C-terminus of the CH3 domain and the N-terminus of the scFv, as described by Coloma, J. et al. (1997) *Nature Biotech* 15:159.

Variable Domain Immunoglobulin DVD

A related format is the dual variable domain immunoglobulin (DVD), which are composed of VH and VL domains of a second specificity place upon the N termini of the V domains by shorter linker sequences.

Other exemplary multispecific antibody formats include, e.g., those described in the following US20160114057A1, US20130243775A1, US20140051833, US20130022601, US20150017187A1, US20120201746A1, US20150133638A1, US20130266568A1, US20160145340A1, WO2015127158A1, US20150203591A1, US20140322221A1, US20130303396A1, US20110293613, US20130017200A1, US20160102135A1, WO2015197598A2, WO2015197582A1, U.S. Pat. No. 9,359,437, US20150018529, WO2016115274A1, WO2016087416A1, US20080069820A1, U.S. Pat. Nos. 9,145,588B, 7,919,257, and US20150232560A1. Exemplary multispecific molecules utilizing a full antibody-Fab/scFab format include those described in the following, U.S. Pat. No. 9,382,323B2, US20140072581A1, US20140308285A1, US20130165638A1, US20130267686A1, US20140377269A1, U.S. Pat. No. 7,741,446B2, and WO1995009917A1. Exemplary multispecific molecules utilizing a domain exchange format include those described in the following, US20150315296A1, WO2016087650A1, US20160075785A1, WO2016016299A1, US20160130347A1, US20150166670, U.S. Pat. No. 8,703,132B2, US20100316645, U.S. Pat. No. 8,227,577B2, US20130078249.

Fc-Containing Entities (Mini-Antibodies)

Fc-containing entities, also known as mini-antibodies, can be generated by fusing scFv to the C-termini of constant heavy region domain 3 (CH3-scFv) and/or to the hinge region (scFv-hinge-Fc) of an antibody with a different specificity. Trivalent entities can also be made which have disulfide stabilized variable domains (without peptide linker) fused to the C-terminus of CH3 domains of IgGs.

Fc-Containing Multispecific Molecules

In some embodiments, the multispecific molecules disclosed herein includes an immunoglobulin constant region (e.g., an Fc region). Exemplary Fc regions can be chosen from the heavy chain constant regions of IgG1, IgG2, IgG3 or IgG4; more particularly, the heavy chain constant region of human IgG1, IgG2, IgG3, or IgG4.

In some embodiments, the immunoglobulin chain constant region (e.g., the Fc region) is altered, e.g., mutated, to increase or decrease one or more of: Fc receptor binding, antibody glycosylation, the number of cysteine residues, effector cell function, or complement function.

In other embodiments, an interface of a first and second immunoglobulin chain constant regions (e.g., a first and a second Fc region) is altered, e.g., mutated, to increase or decrease dimerization, e.g., relative to a non-engineered interface, e.g., a naturally occurring interface. For example, dimerization of the immunoglobulin chain constant region (e.g., the Fc region) can be enhanced by providing an Fc interface of a first and a second Fc region with one or more of: a paired protuberance-cavity ("knob-in-a hole"), an electrostatic interaction, or a strand-exchange, such that a greater ratio of heteromultimer to homomultimer forms, e.g., relative to a non-engineered interface.

In some embodiments, the multispecific molecules include a paired amino acid substitution at a position chosen from one or more of 347, 349, 350, 351, 366, 368, 370, 392, 394, 395, 397, 398, 399, 405, 407, or 409, e.g., of the Fc region of human IgG1 For example, the immunoglobulin chain constant region (e.g., Fc region) can include a paired an amino acid substitution chosen from: T366S, L368A, or Y407V (e.g., corresponding to a cavity or hole), and T366W (e.g., corresponding to a protuberance or knob).

In other embodiments, the multifunctional molecule includes a half-life extender, e.g., a human serum albumin or an antibody molecule to human serum albumin.

Heterodimerized Antibody Molecules & Methods of Making

Various methods of producing multispecific antibodies have been disclosed to address the problem of incorrect heavy chain pairing. Exemplary methods are described below. Exemplary multispecific antibody formats and methods of making said multispecific antibodies are also disclosed in e.g., Speiss et al. Molecular Immunology 67 (2015) 95-106; and Klein et al mAbs 4:6, 653-663; November/December 2012; the entire contents of each of which are incorporated by reference herein.

Heterodimerized bispecific antibodies are based on the natural IgG structure, wherein the two binding arms recognize different antigens. IgG derived formats that enable defined monovalent (and simultaneous) antigen binding are generated by forced heavy chain heterodimerization, combined with technologies that minimize light chain mispairing (e.g., common light chain). Forced heavy chain heterodimerization can be obtained using, e.g., knob-in-hole OR strand exchange engineered domains (SEED).

Knob-in-Hole

Knob-in-Hole as described in U.S. Pat. Nos. 5,731,116, 7,476,724 and Ridgway, J. et al. (1996) *Prot. Engineering* 9(7): 617-621, broadly involves: (1) mutating the CH3 domain of one or both antibodies to promote heterodimerization; and (2) combining the mutated antibodies under conditions that promote heterodimerization. "Knobs" or "protuberances" are typically created by replacing a small amino acid in a parental antibody with a larger amino acid (e.g., T366Y or T366W); "Holes" or "cavities" are created by replacing a larger residue in a parental antibody with a smaller amino acid (e.g., Y407T, T366S, L368A and/or Y407V).

For bispecific antibodies including an Fc domain, introduction of specific mutations into the constant region of the heavy chains to promote the correct heterodimerization of the Fc portion can be utilized. Several such techniques are reviewed in Klein et al. (mAbs (2012) 4:6, 1-11), the contents of which are incorporated herein by reference in their entirety. These techniques include the "knobs-into-holes" (KiH) approach which involves the introduction of a bulky residue into one of the CH3 domains of one of the antibody heavy chains. This bulky residue fits into a complementary "hole" in the other CH3 domain of the paired heavy chain so as to promote correct pairing of heavy chains (see e.g., U.S. Pat. No. 7,642,228).

Exemplary KiH mutations include S354C, T366W in the "knob" heavy chain and Y349C, T366S, L368A, Y407V in the "hole" heavy chain. Other exemplary KiH mutations are provided in Table 1, with additional optional stabilizing Fc cysteine mutations.

TABLE 1

Exemplary Fc KiH mutations and optional Cysteine mutations

| Position | Knob Mutation | Hole Mutation |
|---|---|---|
| T366 | T366W | T366S |
| L368 | — | L368A |
| Y407 | — | Y407V |

Additional Cysteine Mutations to form a stabilizing disulfide bridge

| Position | Knob CH3 | Hole CH3 |
|---|---|---|
| S354 | S354C | — |
| Y349 | — | Y349C |

Other Fc mutations are provided by Igawa and Tsunoda who identified 3 negatively charged residues in the CH3 domain of one chain that pair with three positively charged residues in the CH3 domain of the other chain. These specific charged residue pairs are: E356-K439, E357-K370, D399-K409 and vice versa. By introducing at least two of the following three mutations in chain A: E356K, E357K and D399K, as well as K370E, K409D, K439E in chain B, alone or in combination with newly identified disulfide bridges, they were able to favor very efficient heterodimerization while suppressing homodimerization at the same time (Martens T et al. A novel one-armed antic-Met antibody inhibits glioblastoma growth in vivo. Clin Cancer Res 2006; 12:6144-52; PMID: 17062691). Xencor defined 41 variant pairs based on combining structural calculations and sequence information that were subsequently screened for maximal heterodimerization, defining the combination of S364H, F405A (HA) on chain A and Y349T, T394F on chain B (TF) (Moore G L et al. A novel bispecific antibody format enables simultaneous bivalent and monovalent co-engagement of distinct target antigens. MAbs 2011; 3:546-57; PMID: 22123055).

Other exemplary Fc mutations to promote heterodimerization of multispecific antibodies include those described in the following references, the contents of each of which is incorporated by reference herein, WO2016071377A1, US20140079689A1, US20160194389A1, US20160257763, WO2016071376A2, WO2015107026A1, WO2015107025A1, WO2015107015A1, US20150353636A1, US20140199294A1, U.S. Pat. No. 7,750,128B2, US20160229915A1, US20150344570A1, U.S. Pat. No. 8,003,774A1, US20150337049A1, US20150175707A1, US20140242075A1, US20130195849A1, US20120149876A1, US20140200331A1, U.S. Pat. No. 9,309,311B2, U.S. Pat. No. 8,586,713, US20140037621A1, US20130178605A1, US20140363426A1, US20140051835A1 and US20110054151A1.

Stabilizing cysteine mutations have also been used in combination with KiH and other Fc heterodimerization promoting variants, see e.g., U.S. Pat. No. 7,183,076. Other exemplary cysteine modifications include, e.g., those disclosed in US20140348839A1, U.S. Pat. No. 7,855,275B2, and U.S. Pat. No. 9,000,130B2.

Strand Exchange Engineered Domains (SEED)

Heterodimeric Fc platform that support the design of bispecific and asymmetric fusion proteins by devising strand-exchange engineered domain (SEED) C(H)3 heterodimers are known. These derivatives of human IgG and IgA C(H)3 domains create complementary human SEED C(H)3 heterodimers that are composed of alternating segments of human IgA and IgG C(H)3 sequences. The resulting pair of SEED C(H)3 domains preferentially associates to form heterodimers when expressed in mammalian cells. SEEDbody (Sb) fusion proteins consist of [IgG1 hinge]-C(H)2-[SEED C(H)3], that may be genetically linked to one or more fusion partners (see e.g., Davis J H et al. SEEDbodies: fusion proteins based on strand exchange engineered domain (SEED) CH3 heterodimers in an Fc analogue platform for asymmetric binders or immunofusions and bispecific antibodies. Protein Eng Des Sel 2010; 23:195-202; PMID:20299542 and U.S. Pat. No. 8,871,912. The contents of each of which are incorporated by reference herein).

Duobody

"Duobody" technology to produce bispecific antibodies with correct heavy chain pairing are known. The DuoBody technology involves three basic steps to generate stable bispecific human IgG1 antibodies in a post-production exchange reaction. In a first step, two IgG1s, each containing single matched mutations in the third constant (CH3) domain, are produced separately using standard mammalian recombinant cell lines. Subsequently, these IgG1 antibodies are purified according to standard processes for recovery and purification. After production and purification (post-production), the two antibodies are recombined under tailored laboratory conditions resulting in a bispecific antibody product with a very high yield (typically >95%) (see e.g., Labrijn et al, PNAS 2013; 110(13):5145-5150 and Labrijn et al. Nature Protocols 2014; 9(10):2450-63, the contents of each of which are incorporated by reference herein).

Electrostatic Interactions

Methods of making multispecific antibodies using CH3 amino acid changes with charged amino acids such that homodimer formation is electrostatically unfavorable are disclosed. EP1870459 and WO 2009089004 describe other strategies for favoring heterodimer formation upon co-expression of different antibody domains in a host cell. In these methods, one or more residues that make up the heavy chain constant domain 3 (CH3), CH3-CH3 interfaces in both CH3 domains are replaced with a charged amino acid such that homodimer formation is electrostatically unfavorable and heterodimerization is electrostatically favorable. Additional methods of making multispecific molecules using electrostatic interactions are described in the following references, the contents of each of which is incorporated by reference herein, include US20100015133, U.S. Pat. No. 8,592,562B2, U.S. Pat. No. 9,200,060B2, US20140154254A1, and U.S. Pat. No. 9,358,286A1.

Common Light Chain

Light chain mispairing needs to be avoided to generate homogenous preparations of bispecific IgGs. One way to achieve this is through the use of the common light chain principle, i.e. combining two binders that share one light chain but still have separate specificities. An exemplary method of enhancing the formation of a desired bispecific antibody from a mixture of monomers is by providing a common variable light chain to interact with each of the heteromeric variable heavy chain regions of the bispecific antibody. Compositions and methods of producing bispecific antibodies with a common light chain as disclosed in, e.g., U.S. Pat. No. 7,183,076B2, US20110177073A1, EP2847231A1, WO2016079081A1, and EP3055329A1, the contents of each of which is incorporated by reference herein.

CrossMab

Another option to reduce light chain mispairing is the CrossMab technology which avoids non-specific L chain mispairing by exchanging CH1 and CL domains in the Fab of one half of the bispecific antibody. Such crossover variants retain binding specificity and affinity, but make the two arms so different that L chain mispairing is prevented. The CrossMab technology (as reviewed in Klein et al. Supra) involves domain swapping between heavy and light chains so as to promote the formation of the correct pairings. Briefly, to construct a bispecific IgG-like CrossMab antibody that could bind to two antigens by using two distinct light chain-heavy chain pairs, a two-step modification process is applied. First, a dimerization interface is engineered into the C-terminus of each heavy chain using a heterodimerization approach, e.g., Knob-into-hole (KiH) technology, to ensure that only a heterodimer of two distinct heavy chains from one antibody (e.g., Antibody A) and a second antibody (e.g., Antibody B) is efficiently formed. Next, the constant heavy 1 (CH1) and constant light (CL) domains of one antibody are exchanged (Antibody A), keeping the variable heavy (VH) and variable light (VL) domains consistent. The exchange of the CH1 and CL domains ensured that the modified antibody (Antibody A) light chain would only efficiently dimerize with the modified antibody (antibody A) heavy chain, while the unmodified antibody (Antibody B) light chain would only efficiently dimerize with the unmodified antibody (Antibody B) heavy chain; and thus only the desired bispecific CrossMab would be efficiently formed (see e.g., Cain, C. SciBX 4(28); doi:10.1038/scibx.2011.783, the contents of which are incorporated by reference herein).

Common Heavy Chain

An exemplary method of enhancing the formation of a desired bispecific antibody from a mixture of monomers is by providing a common variable heavy chain to interact with each of the heteromeric variable light chain regions of the bispecific antibody. Compositions and methods of producing bispecific antibodies with a common heavy chain are disclosed in, e.g., US20120184716, US20130317200, and US20160264685A1, the contents of each of which is incorporated by reference herein.

Amino Acid Modifications

Alternative compositions and methods of producing multispecific antibodies with correct light chain pairing include various amino acid modifications. For example, Zymeworks describes heterodimers with one or more amino acid modifications in the CH1 and/or CL domains, one or more amino acid modifications in the VH and/or VL domains, or a combination thereof, which are part of the interface between the light chain and heavy chain and create preferential pairing between each heavy chain and a desired light chain such that when the two heavy chains and two light chains of the heterodimer pair are co-expressed in a cell, the heavy chain of the first heterodimer preferentially pairs with one of the light chains rather than the other (see e.g., WO2015181805). Other exemplary methods are described in WO2016026943 (Argen-X), US20150211001, US20140072581A1, US20160039947A1, and US20150368352.

Lambda Kappa Formats

Multispecific molecules (e.g., multispecific antibody molecules) that include the lambda light chain polypeptide and a kappa light chain polypeptide, can be used to allow for heterodimerization. Methods for generating bispecific antibody molecules comprising the lambda light chain polypeptide and a kappa light chain polypeptide are disclosed in PCT/US17/53053 filed on Sep. 22, 2017, incorporated herein by reference in its entirety.

In embodiments, the multispecific molecules includes a multispecific antibody molecule, e.g., an antibody molecule comprising two binding specificities, e.g., a bispecific antibody molecule. The multispecific antibody molecule includes:

- a lambda light chain polypeptide 1 (LLCP1) specific for a first epitope;
- a heavy chain polypeptide 1 (HCP1) specific for the first epitope;
- a kappa light chain polypeptide 2 (KLCP2) specific for a second epitope; and
- a heavy chain polypeptide 2 (HCP2) specific for the second epitope.

"Lambda light chain polypeptide 1 (LLCP1)", as that term is used herein, refers to a polypeptide comprising sufficient light chain (LC) sequence, such that when combined with a cognate heavy chain variable region, can mediate specific binding to its epitope and complex with an HCP1. In an embodiment it comprises all or a fragment of a CH1 region. In an embodiment, an LLCP1 comprises LC-CDR1, LC-CDR2, LC-CDR3, FR1, FR2, FR3, FR4, and CH1, or sufficient sequence therefrom to mediate specific binding of its epitope and complex with an HCP1. LLCP1, together with its HCP1, provide specificity for a first epitope (while KLCP2, together with its HCP2, provide specificity for a second epitope). As described elsewhere herein, LLCP1 has a higher affinity for HCP1 than for HCP2.

"Kappa light chain polypeptide 2 (KLCP2)", as that term is used herein, refers to a polypeptide comprising sufficient light chain (LC) sequence, such that when combined with a cognate heavy chain variable region, can mediate specific binding to its epitope and complex with an HCP2. In an embodiment, it comprises all or a fragment of a CH1 region. In an embodiment, a KLCP2 comprises LC-CDR1, LC-CDR2, LC-CDR3, FR1, FR2, FR3, FR4, and CH1, or sufficient sequence therefrom to mediate specific binding of its epitope and complex with an HCP2. KLCP2, together with its HCP2, provide specificity for a second epitope (while LLCP1, together with its HCP1, provide specificity for a first epitope).

"Heavy chain polypeptide 1 (HCP1)", as that term is used herein, refers to a polypeptide comprising sufficient heavy chain (HC) sequence, e.g., HC variable region sequence, such that when combined with a cognate LLCP1, can mediate specific binding to its epitope and complex with an HCP1. In an embodiment, it comprises all or a fragment of a CH1 region. In an embodiment, it comprises all or a fragment of a CH2 and/or CH3 region. In an embodiment an HCP1 comprises HC-CDR1, HC-CDR2, HC-CDR3, FR1, FR2, FR3, FR4, CH1, CH2, and CH3, or sufficient sequence therefrom to: (i) mediate specific binding of its epitope and complex with an LLCP1, (ii) to complex preferentially, as described herein to LLCP1 as opposed to KLCP2; and (iii) to complex preferentially, as described herein, to an HCP2, as opposed to another molecule of HCP1. HCP1, together with its LLCP1, provide specificity for a first epitope (while KLCP2, together with its HCP2, provide specificity for a second epitope).

"Heavy chain polypeptide 2 (HCP2)", as that term is used herein, refers to a polypeptide comprising sufficient heavy chain (HC) sequence, e.g., HC variable region sequence, such that when combined with a cognate LLCP1, can mediate specific binding to its epitope and complex with an HCP1. In an embodiment, it comprises all or a fragment of a CH1 region. In an embodiment, it comprises all or a fragment of a CH2 and/or CH3 region. In an embodiment an HCP1 comprises HC-CDR1, HC-CDR2, HC-CDR3, FR1, FR2, FR3, FR4, CH1, CH2, and CH3, or sufficient sequence therefrom to: (i) mediate specific binding of its epitope and complex with an KLCP2, (ii) to complex preferentially, as described herein to KLCP2 as opposed to LLCP1; and (iii) to complex preferentially, as described herein, to an HCP1, as opposed to another molecule of HCP2. HCP2, together with its KLCP2, provide specificity for a second epitope (while LLCP1, together with its HCP1, provide specificity for a first epitope).

In some embodiments of the multispecific antibody molecule disclosed herein:

- LLCP1 has a higher affinity for HCP1 than for HCP2; and/or
- KLCP2 has a higher affinity for HCP2 than for HCP1.

In embodiments, the affinity of LLCP1 for HCP1 is sufficiently greater than its affinity for HCP2, such that under preselected conditions, e.g., in aqueous buffer, e.g., at pH 7, in saline, e.g., at pH 7, or under physiological conditions, at least 75, 80, 90, 95, 98, 99, 99.5, or 99.9% of the multispecific antibody molecule molecules have a LLCP1 complexed, or interfaced with, a HCP1.

In some embodiments of the multispecific antibody molecule disclosed herein:

the HCP1 has a greater affinity for HCP2, than for a second molecule of HCP1; and/or the HCP2 has a greater affinity for HCP1, than for a second molecule of HCP2.

In embodiments, the affinity of HCP1 for HCP2 is sufficiently greater than its affinity for a second molecule of HCP1, such that under preselected conditions, e.g., in aqueous buffer, e.g., at pH 7, in saline, e.g., at pH 7, or under physiological conditions, at least 75%, 80, 90, 95, 98, 99 99.5 or 99.9% of the multispecific antibody molecule molecules have a HCP1 complexed, or interfaced with, a HCP2.

In another aspect, disclosed herein is a method for making, or producing, a multispecific antibody molecule. The method includes:

(i) providing a first heavy chain polypeptide (e.g., a heavy chain polypeptide comprising one, two, three or all of a first heavy chain variable region (first VH), a first CH1, a first heavy chain constant region (e.g., a first CH2, a first CH3, or both));

(ii) providing a second heavy chain polypeptide (e.g., a heavy chain polypeptide comprising one, two, three or all of a second heavy chain variable region (second VH), a second CH1, a second heavy chain constant region (e.g., a second CH2, a second CH3, or both));

(iii) providing a lambda chain polypeptide (e.g., a lambda light variable region (VLλ), a lambda light constant chain (VLλ), or both) that preferentially associates with the first heavy chain polypeptide (e.g., the first VH); and (iv) providing a kappa chain polypeptide (e.g., a lambda light variable region (VLκ), a lambda light constant chain (VLκ), or both) that preferentially associates with the second heavy chain polypeptide (e.g., the second VH), under conditions where (i)-(iv) associate.

In embodiments, the first and second heavy chain polypeptides form an Fc interface that enhances heterodimerization.

In embodiments, (i)-(iv) (e.g., nucleic acid encoding (i)-(iv)) are introduced in a single cell, e.g., a single mammalian cell, e.g., a CHO cell. In embodiments, (i)-(iv) are expressed in the cell.

In embodiments, (i)-(iv) (e.g., nucleic acid encoding (i)-(iv)) are introduced in different cells, e.g., different mammalian cells, e.g., two or more CHO cell. In embodiments, (i)-(iv) are expressed in the cells.

In one embodiment, the method further comprises purifying a cell-expressed antibody molecule, e.g., using a lambda- and/or- kappa-specific purification, e.g., affinity chromatography.

In embodiments, the method further comprises evaluating the cell-expressed multispecific antibody molecule. For example, the purified cell-expressed multispecific antibody molecule can be analyzed by techniques known in the art, include mass spectrometry. In one embodiment, the purified cell-expressed antibody molecule is cleaved, e.g., digested with papain to yield the Fab moieties and evaluated using mass spectrometry.

In embodiments, the method produces correctly paired kappa/lambda multispecific, e.g., bispecific, antibody molecules in a high yield, e.g., at least 75%, 80, 90, 95, 98, 99 99.5 or 99.9%.

In other embodiments, the multispecific, e.g., a bispecific, antibody molecule that includes:

(i) a first heavy chain polypeptide (HCP1) (e.g., a heavy chain polypeptide comprising one, two, three or all of a first heavy chain variable region (first VH), a first CH1, a first heavy chain constant region (e.g., a first CH2, a first CH3, or both)), e.g., wherein the HCP1 binds to a first epitope;

(ii) a second heavy chain polypeptide (HCP2) (e.g., a heavy chain polypeptide comprising one, two, three or all of a second heavy chain variable region (second VH), a second CH1, a second heavy chain constant region (e.g., a second CH2, a second CH3, or both)), e.g., wherein the HCP2 binds to a second epitope;

(iii) a lambda light chain polypeptide (LLCP1) (e.g., a lambda light variable region (VLl), a lambda light constant chain (VLl), or both) that preferentially associates with the first heavy chain polypeptide (e.g., the first VH), e.g., wherein the LLCP1 binds to a first epitope; and (iv) a kappa light chain polypeptide (KLCP2) (e.g., a lambda light variable region (VLk), a lambda light constant chain (VLk), or both) that preferentially associates with the second heavy chain polypeptide (e.g., the second VH), e.g., wherein the KLCP2 binds to a second epitope.

In embodiments, the first and second heavy chain polypeptides form an Fc interface that enhances heterodimerization. In embodiments, the multispecific antibody molecule has a first binding specificity that includes a hybrid VLl-CLl heterodimerized to a first heavy chain variable region connected to the Fc constant, CH2-CH3 domain (having a knob modification) and a second binding specificity that includes a hybrid VLk-CLk heterodimerized to a second heavy chain variable region connected to the Fc constant, CH2-CH3 domain (having a hole modification).

TRBC1 and TRBC2 Antigen Binding Domains

The present disclosure provides, inter alia, antibody molecules, e.g., multispecific (e.g., bi-, tri-, tetra-specific) or multifunctional molecules, that include, e.g., are engineered to contain, one or more antigen binding domains that bind to a tumor antigen on a lymphoma cell (e.g., T cell). In some embodiments, the tumor antigen comprises a T cell receptor comprising TRBC1 or TRBC2. In some embodiments, the antigen binding domain preferentially binds to a T cell receptor comprising TRBC1 (e.g., relative to a T cell receptor comprising TRBC2). In some embodiments, the antigen binding domain preferentially binds to a T cell receptor comprising TRBC2 (e.g., relative to a T cell receptor comprising TRBC1). In some embodiments, the multifunctional molecules include, e.g., are engineered to contain, one or more antigen binding domains that selectively target lymphocytes expressing TRBC1 or TRBC2. In some embodiments, the antigen binding domain selectively targets lymphocytes expressing a T cell receptor comprising TRBC1 or a T cell receptor comprising TRBC2.

T cell receptors (TCRs) are receptors found on the surface of lymphocytes, specifically on T lymphocytes (T cells). TCRs are responsible for recognizing antigen fragments presented by major histocompatibility complex (MHC) molecules on other immune cells (e.g., B cells) by signaling through associated CD3 and activating the T cell. The vast majority of TCRs in humans are heterodimers comprising an alpha chain and a beta chain. Both alpha and beta chains of TCR comprise variable and constant regions. The variable regions of the alpha and beta chain are encoded by distinct DNA elements (V, D, and J elements for beta chain; V and J elements for the alpha chain). Recombination between these elements produces in large part the variation in antigen binding specificity of TCRs. The TCR beta chain constant region is selected from two different domains, beta constant domain 1 and beta constant domain 2. Without wishing to be bound by theory, it is thought that the majority of TCRs comprising a beta chain comprise a beta chain comprising beta constant domain 1 or beta constant domain 2, but not both constant domain 1 and constant domain 2.

In some embodiments, the multifunctional or multispecific molecules or antibody molecules of the present application comprise an antigen binding domain that binds to a tumor antigen on a lymphoma cell (e.g., a T cell), e.g., a T cell receptor comprising TRBC1, TRBC1, a T cell receptor comprising TRBC2, or TRBC2. In some embodiments, the multifunctional or multispecific molecules or antibody molecules of the present application comprise an antigen binding domain that selectively targets lymphocytes expressing a T cell receptor comprising TRBC1, TRBC1, a T cell receptor comprising TRBC2, or TRBC2. While it is most typical for a lymphocyte or lymphoma cell presenting a T cell receptor comprising TRBC1 or TRBC2 to be a T cell, cancer causes many disruptions in non-disease expression patterns. Thus, in some embodiments, the lymphoma cell or lymphocyte may not be a T cell. In some embodiments, the lymphoma cell or lymphocyte is a B cell. In some embodiments, the lymphoma cell or lymphocyte is a natural killer cell.

In some embodiments, the antigen binding domain (e.g., first antigen binding domain) comprises any CDR amino acid sequence, framework region (FWR) amino acid sequence, or variable region amino acid sequence of an anti-TRBC1 antibody known in the art. In some embodiments, CDR amino acid sequence, framework region (FWR) amino acid sequence, or variable region amino acid sequence are selected from JOVI.1.

TRBC1 Antigen Binding Domains

In some embodiments, the antigen binding domain that binds to TRBC1 comprises one or more CDRs (e.g., VHCDR1, VHCDR2, VHCDR3, VLCDR1, VLCDR2, and/or VLCDR3) disclosed in Table 2A or Table 2B, Table 3A or Table 3B, or Table 4, or a sequence having at least 85%, 90%, 95%, or 99% identity thereto. In some embodiments, the antigen binding domain that binds to TRBC1 comprises one or more framework regions (e.g., VHFWR1, VHFWR2, VHFWR3, VHFWR4, VLFWR1, VLFWR2, VLFWR3, and/or VLFWR4) disclosed in Table 2A or Table 2B, Table 3A or Table 3B, or Table 4, or a sequence having at least 85%, 90%, 95%, or 99% identity thereto. In some embodiments, the antigen binding domain that binds to TRBC1 comprises a VH and/or a VL disclosed in Table 7, or a sequence having at least 85%, 90%, 95%, or 99% identity thereto. In some embodiments, the antigen binding domain that binds to TRBC1 comprises an amino acid sequence disclosed in Table 8, or a sequence having at least 85%, 90%, 95%, or 99% identity thereto.

In some embodiments, the antigen binding domain that binds to TRBC1 comprises one or more CDRs (e.g., VHCDR1, VHCDR2, VHCDR3, VLCDR1, VLCDR2, and/or VLCDR3) disclosed in Table 5 and/or 3B, or a sequence having at least 85%, 90%, 95%, or 99% identity thereto. In some embodiments, the antigen binding domain that binds to TRBC1 comprises one or more framework regions (e.g., VHFWR1, VHFWR2, VHFWR3, VHFWR4, VLFWR1, VLFWR2, VLFWR3, and/or VLFWR4) disclosed in Table 5 and/or 3B, or a sequence having at least 85%, 90%, 95%, or 99% identity thereto. In some embodiments, the antigen binding domain that binds to TRBC1 comprises a VH and/or a VL disclosed in Table 7, or a sequence having at least 85%, 90%, 95%, or 99% identity thereto In some embodiments, the antigen binding domain that binds to TRBC1 comprises a VH comprising a heavy chain complementarity determining region 1 (VHCDR1), a VHCDR2, and a VHCDR3, and a VL comprising a light chain complementarity determining region 1 (VLCDR1), a VLCDR2, and a VLCDR3.

In some embodiments, the VHCDR1, VHCDR2, and VHCDR3 comprise the amino acid sequences of SEQ ID NOs: 7346, 7355, and 202, respectively (or a sequence having at least 85%, 90%, 95%, or 99% identity thereto). In some embodiments, the VHCDR1, VHCDR2, and VHCDR3 comprise the amino acid sequences of SEQ ID NOs: 7346, 201, and 202, respectively (or a sequence having at least 85%, 90%, 95%, or 99% identity thereto). In some embodiments, the VHCDR1, VHCDR2, and VHCDR3 comprise the amino acid sequences of SEQ ID NOs: 7354, 201, and 202, respectively (or a sequence having at least 85%, 90%, 95%, or 99% identity thereto). In some embodiments, the VHCDR1, VHCDR2, and VHCDR3 comprise the amino acid sequences of SEQ ID NOs: 7354, 7355, and 202, respectively (or a sequence having at least 85%, 90%, 95%, or 99% identity thereto).

In some embodiments, the VLCDR1, VLCDR2, and VLCDR3 comprise the amino acid sequences of SEQ ID NOs: 223, 224, and 225, respectively (or a sequence having at least 85%, 90%, 95%, or 99% identity thereto). In some embodiments, the VLCDR1, VLCDR2, and VLCDR3 comprise the amino acid sequences of SEQ ID NOs: 7367, 224, and 225, respectively (or a sequence having at least 85%, 90%, 95%, or 99% identity thereto). In some embodiments, the VLCDR1, VLCDR2, and VLCDR3 comprise the amino acid sequences of SEQ ID NOs: 223, 7368, and 225, respectively (or a sequence having at least 85%, 90%, 95%, or 99% identity thereto). In some embodiments, the VLCDR1, VLCDR2, and VLCDR3 comprise the amino acid sequences of SEQ ID NOs: 223, 224, and 7369, respectively (or a sequence having at least 85%, 90%, 95%, or 99% identity thereto). In some embodiments, the VLCDR1, VLCDR2, and VLCDR3 comprise the amino acid sequences of SEQ ID NOs: 7367, 7368, and 7369, respectively (or a sequence having at least 85%, 90%, 95%, or 99% identity thereto).

In some embodiments, the VHCDR1, VHCDR2, VHCDR3, VLCDR1, VLCDR2, and VLCDR3 comprise the amino acid sequences of SEQ ID NOs: 7346, 7355, 202, 223, 224, and 225, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 7346, 201, 202, 223, 224, and 225, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of: SEQ ID NOs: 7346, 7355, 202, 7367, 224, and 225, respectively (or a sequence having at least 85%, 90%, 95%, or 99% identity thereto); SEQ ID NOs: 7346, 7355, 202, 223, 7368, and 225, respectively (or a sequence having at least 85%, 90%, 95%, or 99% identity thereto); SEQ ID NOs: 7346, 7355, 202, 223, 224, and 7369, respectively (or a sequence having at least 85%, 90%, 95%, or 99% identity thereto); SEQ ID NOs: 7346, 7355, 202, 7367, 7368, and 7369, respectively (or a sequence having at least 85%, 90%, 95%, or 99% identity thereto); SEQ ID NOs: 7346, 201, 202, 7367, 224, and 225, respectively (or a sequence having at least 85%, 90%, 95%, or 99% identity thereto); SEQ ID NOs: 7346, 201, 202, 223, 7368, and 225, respectively (or a sequence having at least 85%, 90%, 95%, or 99% identity thereto); SEQ ID NOs: 7346, 201, 202, 223, 224, and 7369, respectively (or a sequence having at least 85%, 90%, 95%, or 99% identity thereto); SEQ ID NOs: 7346, 201, 202, 7367, 7368, and 7369, respectively (or a sequence having at least 85%, 90%, 95%, or 99% identity thereto); SEQ ID NOs: 7354, 201, 202, 223, 224, and 225, respectively (or a sequence having at least 85%, 90%, 95%, or 99% identity thereto); SEQ ID NOs: 7354, 201, 202, 7367, 224, and 225, respectively (or a sequence having at least 85%, 90%, 95%, or 99% identity thereto); SEQ ID NOs: 7354, 201, 202, 223, 7368, and 225, respectively (or a sequence having at least 85%, 90%, 95%, or 99% identity thereto); SEQ ID NOs: 7354, 201, 202, 223, 224, and 7369, respectively (or a sequence having at least 85%, 90%, 95%, or 99% identity thereto); SEQ ID NOs: 7354, 201, 202, 7367, 7368, and 7369, respectively (or a sequence having at least 85%, 90%, 95%, or 99% identity thereto); SEQ ID NOs: 7354, 7355, 202, 223, 224, and 225, respectively (or a sequence having at least 85%, 90%, 95%, or 99% identity thereto); SEQ ID NOs: 7354, 7355, 202, 7367, 224, and 225, respectively (or a sequence having at least 85%, 90%, 95%, or 99% identity thereto); SEQ ID NOs: 7354, 7355, 202, 223, 7368, and 225, respectively (or a sequence having at least 85%, 90%, 95%, or 99% identity thereto); SEQ ID NOs: 7354, 7355, 202, 223, 224, and 7369, respectively (or a sequence having at least 85%, 90%, 95%, or 99% identity thereto); or SEQ ID NOs: 7354, 7355, 202, 7367, 7368, and 7369, respectively (or a sequence having at least 85%, 90%, 95%, or 99% identity thereto).

In some embodiments, the VH comprises an amino acid sequence selected from the group consisting of SEQ ID NOs: 7351, 253, 250-252, 254, 7343, 7344, 7350, and 7352 (or a sequence having at least 85%, 90%, 95%, or 99% identity thereto) and/or the VL comprises an amino acid sequence selected from the group consisting of SEQ ID NOs: 258, 255-257, 259, 260, and 7357-7360 (or a sequence having at least 85%, 90%, 95%, or 99% identity thereto). In some embodiments, the VH and VL comprise the amino acid sequences of SEQ ID NOs: 7351 and 258, respectively (or a sequence having at least 85%, 90%, 95%, or 99% identity thereto). In some embodiments, the VH and VL comprise the amino acid sequences of SEQ ID NOs: 253 and 258, respectively (or a sequence having at least 85%, 90%, 95%, or 99% identity thereto).

In some embodiments, the antigen binding domain (e.g., first antigen binding domain) that binds to a tumor antigen on a lymphoma cell (e.g., a T cell), e.g., a T cell receptor comprising TRBC1, TRBC1, a T cell receptor comprising TRBC2, or TRBC2 comprises any CDR amino acid sequence, framework region (FWR) amino acid sequence, or variable region amino acid sequence Table 1, Table 2A or Table 2B, Table 3A or Table 3B, Table 4, Table 7, and Table 8. In some embodiments, the antigen binding domain (e.g., first antigen binding domain) that binds to a tumor antigen on a lymphoma cell (e.g., a T cell), e.g., a T cell receptor comprising TRBC1, TRBC1, a T cell receptor comprising TRBC2, or TRBC2 comprises heavy and/or light chain amino acid sequences of Table 8. In some embodiments, the antigen binding domain (e.g., first antigen binding domain) that selectively targets lymphocytes expressing a T cell receptor comprising TRBC1, TRBC1, a T cell receptor comprising TRBC2, or TRBC2 comprises any CDR amino acid sequence, framework region (FWR) amino acid sequence, or variable region amino acid sequence disclosed in Table 1, Table 2A or Table 2B, Table 3A or Table 3B, Table 4, Table 7, and Table 8. In some embodiments, the antigen binding domain (e.g., first antigen binding domain) that selectively targets lymphocytes expressing a T cell receptor comprising TRBC1, TRBC1, a T cell receptor comprising TRBC2, or TRBC2 comprises heavy and/or light chain amino acid sequences of Table 8. An antigen binding domain that binds to a tumor antigen comprising TRBC1 or selectively targets lymphocytes expressing TRBC1 may be said to target TRBC1 (i.e., a TRBC1-targeting antigen binding domain). An antigen binding domain that binds to a tumor antigen comprising TRBC2 or selectively targets lymphocytes expressing TRBC2 may be said to target TRBC2 (i.e., a TRBC2-targeting antigen binding domain).

In some embodiments, the antigen binding domain that targets TRBC1 comprises a VH comprising a heavy chain complementarity determining region 1 (VHCDR1) amino acid sequence of SEQ ID NO: 200 (or a sequence with no more than 1, 2, 3, or 4 mutations, e.g., substitutions, additions, or deletions), a VHCDR2 amino acid sequence of SEQ ID NO: 201 (or a sequence with no more than 1, 2, 3, or 4 mutations, e.g., substitutions, additions, or deletions), and/or a VHCDR3 amino acid sequence of SEQ ID NO: 202 (or a sequence with no more than 1, 2, 3, or 4 mutations, e.g., substitutions, additions, or deletions). In some embodiments, the TRBC1 antigen binding domain comprises a VH comprising a VHCDR1 amino acid sequence of SEQ ID NO: 200, a VHCDR2 amino acid sequence of SEQ ID NO: 201, and/or a VHCDR3 amino acid sequence of SEQ ID NO: 202.

In some embodiments, the antigen binding domain that targets TRBC1 comprises a VL comprising a light chain complementarity determining region 1 (VLCDR1) amino acid sequence of SEQ ID NO: 223 (or a sequence with no more than 1, 2, 3, or 4 mutations, e.g., substitutions, additions, or deletions), a VLCDR2 amino acid sequence of SEQ ID NO: 224 (or a sequence with no more than 1, 2, 3, or 4 mutations, e.g., substitutions, additions, or deletions), and/or a VLCDR3 amino acid sequence of SEQ ID NO: 225 (or a sequence with no more than 1, 2, 3, or 4 mutations, e.g., substitutions, additions, or deletions). In some embodiments, the antigen binding domain that targets TRBC1 comprises a VL comprising a VLCDR1 amino acid sequence of SEQ ID NO: 223, a VLCDR2 amino acid sequence of SEQ ID NO: 224, and a VLCDR3 amino acid sequence of SEQ ID NO: 225.

In some embodiments, the antigen binding domain that targets TRBC1 comprises a $V_H$ comprising a heavy chain framework region 1 (VHFWR1) amino acid sequence of SEQ ID NO: 203, a VHFWR2 amino acid sequence of SEQ ID NO: 204, a VHFWR3 amino acid sequence of SEQ ID NO: 205, and/or a VHFWR4 amino acid sequence of SEQ ID NO: 206.

In some embodiments, the antigen binding domain that targets TRBC1 comprises a VL comprising a light chain framework region 1 (VLFWR1) amino acid sequence of SEQ ID NO: 226, a VLFWR2 amino acid sequence of SEQ ID NO: 227, a VLFWR3 amino acid sequence of SEQ ID NO: 228, and/or a VLFWR4 amino acid sequence of SEQ ID NO: 229.

In some embodiments, the antigen binding domain that targets TRBC1 comprises a VH comprising a VHFWR1 amino acid sequence of SEQ ID NO: 203 (or a sequence with no more than 1, 2, 3, 4, 5, or 6 mutations, e.g., substitutions, additions, or deletions, therefrom), a VHFWR2 amino acid sequence of SEQ ID NO: 204 (or a sequence with no more than 1, 2, 3, 4, 5, or 6 mutations, e.g., substitutions, additions, or deletions, therefrom), a VHFWR3 amino acid sequence of SEQ ID NO: 205 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 206.

In some embodiments, the antigen binding domain that targets TRBC1 comprises a VL comprising a VLFWR1 amino acid sequence of SEQ ID NO: 226 (or a sequence with no more than 1, 2, or 3 mutations, e.g., substitutions, additions, or deletions), a VLFWR2 amino acid sequence of SEQ ID NO: 227 (or a sequence with no more than 1 mutation, e.g., substitution, addition, or deletion), a VLFWR3 amino acid sequence of SEQ ID NO: 228 (or a sequence with no more than 1 mutation, e.g., substitution, addition, or deletion), and/or a VLFWR4 amino acid sequence of SEQ ID NO: 229.

In some embodiments, the antigen binding domain that targets TRBC1 comprises a VH comprising a heavy chain framework region 1 (VHFWR1) amino acid sequence of SEQ ID NO: 207, a VHFWR2 amino acid sequence of SEQ ID NO: 208, a VHFWR3 amino acid sequence of SEQ ID NO: 209, and/or a VHFWR4 amino acid sequence of SEQ ID NO: 210.

In some embodiments, the antigen binding domain that targets TRBC1 comprises a VH comprising a VHFWR1 amino acid sequence of SEQ ID NO: 207 (or a sequence with no more than 1, 2, 3, 4, 5, or 6 mutations, e.g., substitutions, additions, or deletions, therefrom), a VHFWR2 amino acid sequence of SEQ ID NO: 208 (or a sequence with no more than 1, 2, 3, 4, 5, or 6 mutations, e.g., substitutions, additions, or deletions, therefrom), a VHFWR3 amino acid sequence of SEQ ID NO: 209 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 210.

In some embodiments, the antigen binding domain that targets TRBC1 comprises a VH comprising a heavy chain framework region 1 (VHFWR1) amino acid sequence of SEQ ID NO: 211, a VHFWR2 amino acid sequence of SEQ ID NO: 212, a VHFWR3 amino acid sequence of SEQ ID NO: 213, and/or a VHFWR4 amino acid sequence of SEQ ID NO: 214.

In some embodiments, the antigen binding domain that targets TRBC1 comprises a VH comprising a VHFWR1 amino acid sequence of SEQ ID NO: 211 (or a sequence with no more than 1, 2, 3, 4, 5, or 6 mutations, e.g., substitutions, additions, or deletions, therefrom), a VHFWR2 amino acid sequence of SEQ ID NO: 212 (or a sequence with no more than 1, 2, 3, 4, 5, or 6 mutations, e.g., substitutions, additions, or deletions, therefrom), a VHFWR3 amino acid sequence of SEQ ID NO: 213 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 214.

In some embodiments, the antigen binding domain that targets TRBC1 comprises a VH comprising a heavy chain framework region 1 (VHFWR1) amino acid sequence of SEQ ID NO: 215, a VHFWR2 amino acid sequence of SEQ ID NO: 216, a VHFWR3 amino acid sequence of SEQ ID NO: 217, and/or a VHFWR4 amino acid sequence of SEQ ID NO: 218.

In some embodiments, the antigen binding domain that targets TRBC1 comprises a VH comprising a VHFWR1 amino acid sequence of SEQ ID NO: 215 (or a sequence with no more than 1, 2, 3, 4, 5, or 6 mutations, e.g., substitutions, additions, or deletions, therefrom), a VHFWR2 amino acid sequence of SEQ ID NO: 216 (or a sequence with no more than 1, 2, 3, 4, 5, or 6 mutations, e.g., substitutions, additions, or deletions, therefrom), a VHFWR3 amino acid sequence of SEQ ID NO: 217 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 218.

In some embodiments, the antigen binding domain that targets TRBC1 comprises a VH comprising a heavy chain framework region 1 (VHFWR1) amino acid sequence of SEQ ID NO: 219, a VHFWR2 amino acid sequence of SEQ ID NO: 220, a VHFWR3 amino acid sequence of SEQ ID NO: 221, and/or a VHFWR4 amino acid sequence of SEQ ID NO: 222.

In some embodiments, the antigen binding domain that targets TRBC1 comprises a VH comprising a VHFWR1 amino acid sequence of SEQ ID NO: 219 (or a sequence with no more than 1, 2, 3, 4, 5, or 6 mutations, e.g., substitutions, additions, or deletions, therefrom), a VHFWR2 amino acid sequence of SEQ ID NO: 220 (or a sequence with no more than 1, 2, 3, 4, 5, or 6 mutations, e.g., substitutions, additions, or deletions, therefrom), a VHFWR3 amino acid sequence of SEQ ID NO: 221 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 222.

In some embodiments, the antigen binding domain that targets TRBC1 comprises a VL comprising a light chain framework region 1 (VLFWR1) amino acid sequence of SEQ ID NO: 230, a VLFWR2 amino acid sequence of SEQ ID NO: 231, a VLFWR3 amino acid sequence of SEQ ID NO: 232, and/or a VLFWR4 amino acid sequence of SEQ ID NO: 233.

In some embodiments, the antigen binding domain that targets TRBC1 comprises a VL comprising a VLFWR1 amino acid sequence of SEQ ID NO: 230 (or a sequence with no more than 1, 2, or 3 mutations, e.g., substitutions, additions, or deletions), a VLFWR2 amino acid sequence of SEQ ID NO: 231 (or a sequence with no more than 1 mutation, e.g., substitution, addition, or deletion), a VLFWR3 amino acid sequence of SEQ ID NO: 232 (or a sequence with no more than 1 mutation, e.g., substitution, addition, or deletion), and/or a VLFWR4 amino acid sequence of SEQ ID NO: 233.

In some embodiments, the antigen binding domain that targets TRBC1 comprises a VL comprising a light chain framework region 1 (VLFWR1) amino acid sequence of SEQ ID NO: 234, a VLFWR2 amino acid sequence of SEQ ID NO: 235, a VLFWR3 amino acid sequence of SEQ ID NO: 236, and/or a VLFWR4 amino acid sequence of SEQ ID NO: 237.

In some embodiments, the antigen binding domain that targets TRBC1 comprises a VL comprising a VLFWR1 amino acid sequence of SEQ ID NO: 234 (or a sequence with no more than 1, 2, or 3 mutations, e.g., substitutions, additions, or deletions), a VLFWR2 amino acid sequence of SEQ ID NO: 235 (or a sequence with no more than 1 mutation, e.g., substitution, addition, or deletion), a VLFWR3 amino acid sequence of SEQ ID NO: 236 (or a sequence with no more than 1 mutation, e.g., substitution, addition, or deletion), and/or a VLFWR4 amino acid sequence of SEQ ID NO: 237.

In some embodiments, the antigen binding domain that targets TRBC1 comprises a VL comprising a light chain framework region 1 (VLFWR1) amino acid sequence of SEQ ID NO: 238, a VLFWR2 amino acid sequence of SEQ ID NO: 239, a VLFWR3 amino acid sequence of SEQ ID NO: 240, and/or a VLFWR4 amino acid sequence of SEQ ID NO: 241.

In some embodiments, the antigen binding domain that targets TRBC1 comprises a VL comprising a VLFWR1 amino acid sequence of SEQ ID NO: 238 (or a sequence with no more than 1, 2, or 3 mutations, e.g., substitutions, additions, or deletions), a VLFWR2 amino acid sequence of SEQ ID NO: 239 (or a sequence with no more than 1 mutation, e.g., substitution, addition, or deletion), a VLFWR3 amino acid sequence of SEQ ID NO: 240 (or a sequence with no more than 1 mutation, e.g., substitution, addition, or deletion), and/or a VLFWR4 amino acid sequence of SEQ ID NO: 241.

In some embodiments, the antigen binding domain that targets TRBC1 comprises a VL comprising a light chain framework region 1 (VLFWR1) amino acid sequence of SEQ ID NO: 242, a VLFWR2 amino acid sequence of SEQ ID NO: 243, a VLFWR3 amino acid sequence of SEQ ID NO: 244, and/or a VLFWR4 amino acid sequence of SEQ ID NO: 245.

In some embodiments, the antigen binding domain that targets TRBC1 comprises a VL comprising a VLFWR1 amino acid sequence of SEQ ID NO: 242 (or a sequence with no more than 1, 2, or 3 mutations, e.g., substitutions, additions, or deletions), a VLFWR2 amino acid sequence of SEQ ID NO: 243 (or a sequence with no more than 1 mutation, e.g., substitution, addition, or deletion), a VLFWR3 amino acid sequence of SEQ ID NO: 244 (or a sequence with no more than 1 mutation, e.g., substitution, addition, or deletion), and/or a VLFWR4 amino acid sequence of SEQ ID NO: 245.

In some embodiments, the antigen binding domain that targets TRBC1 comprises a VL comprising a light chain framework region 1 (VLFWR1) amino acid sequence of SEQ ID NO: 246, a VLFWR2 amino acid sequence of SEQ ID NO: 247, a VLFWR3 amino acid sequence of SEQ ID NO: 248, and/or a VLFWR4 amino acid sequence of SEQ ID NO: 249.

In some embodiments, the antigen binding domain that targets TRBC1 comprises a VL comprising a VLFWR1 amino acid sequence of SEQ ID NO: 246 (or a sequence with no more than 1, 2, or 3 mutations, e.g., substitutions, additions, or deletions), a VLFWR2 amino acid sequence of SEQ ID NO: 247 (or a sequence with no more than 1 mutation, e.g., substitution, addition, or deletion), a VLFWR3 amino acid sequence of SEQ ID NO: 248 (or a sequence with no more than 1 mutation, e.g., substitution, addition, or deletion), and/or a VLFWR4 amino acid sequence of SEQ ID NO: 249.

In some embodiments, the antigen binding domain that targets TRBC1 comprises a VH comprising the amino acid sequence of SEQ ID NO: 250 (or an amino acid sequence having at least about 77%, 80%, 85%, 90%, 95%, or 99% sequence identity to SEQ ID NO: 250). In some embodiments, the antigen binding domain that targets TRBC1 comprises a VL comprising the amino acid sequence of SEQ ID NO: 255 (or an amino acid sequence having at least about 93%, 95%, or 99% sequence identity to SEQ ID NO: 255). In some embodiments, antigen binding domain that targets TRBC1 comprises a VH comprising the amino acid sequence of SEQ ID NO: 250. In some embodiments, the antigen binding domain that targets TRBC1 comprises a VL comprising the amino acid sequence of SEQ ID NO: 255.

In some embodiments, the antigen binding domain that targets TRBC1 comprises a VH comprising the amino acid sequence of SEQ ID NO: 250, and a VL comprising the amino acid sequence of SEQ ID NO: 255.

In some embodiments, the antigen binding domain that targets TRBC1 comprises a VH comprising the amino acid sequence of SEQ ID NO: 251 (or an amino acid sequence having at least about 77%, 80%, 85%, 90%, 95%, or 99% sequence identity to SEQ ID NO: 251). In some embodiments, antigen binding domain that targets TRBC1 comprises a VH comprising the amino acid sequence of SEQ ID NO: 251.

In some embodiments, the antigen binding domain that targets TRBC1 comprises a VH comprising the amino acid sequence of SEQ ID NO: 252 (or an amino acid sequence having at least about 77%, 80%, 85%, 90%, 95%, or 99% sequence identity to SEQ ID NO: 252). In some embodiments, antigen binding domain that targets TRBC1 comprises a VH comprising the amino acid sequence of SEQ ID NO: 252.

In some embodiments, the antigen binding domain that targets TRBC1 comprises a VH comprising the amino acid sequence of SEQ ID NO: 253 (or an amino acid sequence having at least about 77%, 80%, 85%, 90%, 95%, or 99% sequence identity to SEQ ID NO: 253). In some embodiments, antigen binding domain that targets TRBC1 comprises a VH comprising the amino acid sequence of SEQ ID NO: 253.

In some embodiments, the antigen binding domain that targets TRBC1 comprises a VH comprising the amino acid sequence of SEQ ID NO: 254 (or an amino acid sequence having at least about 77%, 80%, 85%, 90%, 95%, or 99% sequence identity to SEQ ID NO: 254). In some embodiments, antigen binding domain that targets TRBC1 comprises a VH comprising the amino acid sequence of SEQ ID NO: 254.

In some embodiments, the antigen binding domain that targets TRBC1 comprises a VL comprising the amino acid sequence of SEQ ID NO: 256 (or an amino acid sequence having at least about 93%, 95%, or 99% sequence identity to SEQ ID NO: 256). In some embodiments, the antigen binding domain that targets TRBC1 comprises a VL comprising the amino acid sequence of SEQ ID NO: 256.

In some embodiments, the antigen binding domain that targets TRBC1 comprises a VL comprising the amino acid sequence of SEQ ID NO: 257 (or an amino acid sequence having at least about 93%, 95%, or 99% sequence identity to SEQ ID NO: 257). In some embodiments, the antigen binding domain that targets TRBC1 comprises a VL comprising the amino acid sequence of SEQ ID NO: 257.

In some embodiments, the antigen binding domain that targets TRBC1 comprises a VL comprising the amino acid sequence of SEQ ID NO: 258 (or an amino acid sequence having at least about 93%, 95%, or 99% sequence identity to SEQ ID NO: 258). In some embodiments, the antigen binding domain that targets TRBC1 comprises a VL comprising the amino acid sequence of SEQ ID NO: 258.

In some embodiments, the antigen binding domain that targets TRBC1 comprises a VL comprising the amino acid sequence of SEQ ID NO: 259 (or an amino acid sequence having at least about 93%, 95%, or 99% sequence identity to SEQ ID NO: 259). In some embodiments, the antigen binding domain that targets TRBC1 comprises a VL comprising the amino acid sequence of SEQ ID NO: 259.

In some embodiments, the antigen binding domain that targets TRBC1 comprises a VL comprising the amino acid sequence of SEQ ID NO: 260 (or an amino acid sequence having at least about 93%, 95%, or 99% sequence identity to SEQ ID NO: 260). In some embodiments, the antigen binding domain that targets TRBC1 comprises a VL comprising the amino acid sequence of SEQ ID NO: 260.

In some embodiments, the antigen binding domain that targets TRBC1 comprises a heavy chain comprising the amino acid sequence of SEQ ID NO: 6154 (or an amino acid sequence having at least about 93%, 95%, or 99% sequence identity to SEQ ID NO: 6154). In some embodiments, the antigen binding domain that targets TRBC1 comprises a heavy chain comprising the amino acid sequence of SEQ ID NO: 6154.

In some embodiments, the antigen binding domain that targets TRBC1 comprises a heavy chain comprising the amino acid sequence of SEQ ID NO: 6155 (or an amino acid sequence having at least about 93%, 95%, or 99% sequence identity to SEQ ID NO: 6155). In some embodiments, the antigen binding domain that targets TRBC1 comprises a heavy chain comprising the amino acid sequence of SEQ ID NO: 6155.

In some embodiments, the antigen binding domain that targets TRBC1 comprises a light chain comprising the amino acid sequence of SEQ ID NO: 6156 (or an amino acid sequence having at least about 93%, 95%, or 99% sequence identity to SEQ ID NO: 6156). In some embodiments, the antigen binding domain that targets TRBC1 comprises a light chain comprising the amino acid sequence of SEQ ID NO: 6156.

In some embodiments, the antigen binding domain that targets TRBC1 comprises a heavy chain comprising the amino acid sequence of SEQ ID NO: 6167 (or an amino acid sequence having at least about 93%, 95%, or 99% sequence identity to SEQ ID NO: 6167). In some embodiments, the antigen binding domain that targets TRBC1 comprises a heavy chain comprising the amino acid sequence of SEQ ID NO: 6167.

In some embodiments, the antigen binding domain that targets TRBC1 comprises a heavy chain comprising the amino acid sequence of SEQ ID NO: 6168 (or an amino acid sequence having at least about 93%, 95%, or 99% sequence identity to SEQ ID NO: 6168). In some embodiments, the antigen binding domain that targets TRBC1 comprises a heavy chain comprising the amino acid sequence of SEQ ID NO: 6168.

In some embodiments, the antigen binding domain that targets TRBC1 comprises a light chain comprising the amino acid sequence of SEQ ID NO: 6169 (or an amino acid sequence having at least about 93%, 95%, or 99% sequence identity to SEQ ID NO: 6169). In some embodiments, the antigen binding domain that targets TRBC1 comprises a light chain comprising the amino acid sequence of SEQ ID NO: 6169.

In some embodiments, the antigen binding domain that targets TRBC1 comprises a heavy chain comprising the amino acid sequence of SEQ ID NO: 6154 (or an amino acid sequence having at least about 93%, 95%, or 99% sequence identity to SEQ ID NO: 6154) and a light chain comprising the amino acid sequence of SEQ ID NO: 6156 (or an amino acid sequence having at least about 93%, 95%, or 99% sequence identity to SEQ ID NO: 6156). In some embodiments, the antigen binding domain that targets TRBC1 comprises a heavy chain comprising the amino acid sequence of SEQ ID NO: 6154 and a light chain comprising the amino acid sequence of SEQ ID NO: 6156.

In some embodiments, the antigen binding domain that targets TRBC1 comprises a heavy chain comprising the amino acid sequence of SEQ ID NO: 6155 (or an amino acid sequence having at least about 93%, 95%, or 99% sequence identity to SEQ ID NO: 6155) and a light chain comprising the amino acid sequence of SEQ ID NO: 6156 (or an amino acid sequence having at least about 93%, 95%, or 99% sequence identity to SEQ ID NO: 6156). In some embodiments, the antigen binding domain that targets TRBC1 comprises a heavy chain comprising the amino acid sequence of SEQ ID NO: 6155 and a light chain comprising the amino acid sequence of SEQ ID NO: 6156.

In some embodiments, the antigen binding domain that targets TRBC1 comprises a heavy chain comprising the amino acid sequence of SEQ ID NO: 6167 (or an amino acid sequence having at least about 93% A 95 SK, or 99 sequence identity to SEQ ID NO: 6167) and a light chain comprising the amino acid sequence of SEQ ID NO: 6169 (or an amino acid sequence having at least about 93%, 95% or 99% sequence identity to SEQ ID NO: 6169). In some embodiments, the antigen binding domain that targets TRBC 1 comprises a heavy chain comprising the amino acid sequence of SEQ ID NO: 6167 and a light chain comprising the amino acid sequence of SEQ ID NO: 6169.

In some embodiments, the antigen binding domain that targets TRBC 1 comprises a heavy chain comprising the amino acid sequence of SEQ ID NO: 6168 (or an amino acid sequence having at least about 93%, 95%, or 99% sequence identity to SEQ ID NO: 6168) and a light chain comprising the amino acid sequence of SEQ ID NO: 6169 (or an amino acid sequence having at least about 93%, 95%, or 99% sequence identity to SEQ ID NO: 6169). In some embodiments, the antigen binding domain that targets TRBC 1 comprises a heavy chain comprising the amino acid sequence of SEQ ID NO: 6168 and a light chain comprising the amino acid sequence of SEQ ID NO: 6169.

TABLE 2A

Exemplary heavy chain CDRs and FWRs of TRBC1-targeting antigen binding domains derived from JOVI.1 (according to Kabat numbering convention)

| Ab ID | VHFWR1 | VHCDR1 | VHFWR2 | VHCDR2 | VHFWR3 | VHCDR3 | VHFWR4 |
|---|---|---|---|---|---|---|---|
| mJOVI.1-H | EVRLQQS GPDLIKPG ASVKMSC KASGYTF T (SEQ ID NO: 203) | GYVMH (SEQ ID NO: 200) | WVKQRP GQGLEWI G (SEQ ID NO: 204) | FINPYN DDIQSN ERFRG (SEQ ID NO: 201) | KATLTSDK SSTTAYME LSSLTSED SAVYYCA R (SEQ ID NO: 205) | GAGYNF DGAYRF FDF (SEQ ID NO: 202) | WGQGTT LTVSS (SEQ ID NO: 206) |
| h1JOVI.1-H | QVQLVQS GAEVKKP | GYVMH (SEQ ID | WVRQAP GQGLEW | FINPYN DDIQSN | RVTMTSD KSTTTAY | GAGYNF DGAYRF | WGQGTL VTVSS |

TABLE 2A-continued

Exemplary heavy chain CDRs and FWRs of TRBC1-targeting antigen binding domains derived from JOVI.1 (according to Kabat numbering convention)

| Ab ID | VHFWR1 | VHCDR1 | VHFWR2 | VHCDR2 | VHFWR3 | VHCDR3 | VHFWR4 |
|---|---|---|---|---|---|---|---|
| | GASVKVS CKASGYT FT (SEQ ID NO: 207) | NO: 200) | MG (SEQ ID NO: 208) | ERFRG (SEQ ID NO: 201) | MELSSLRS EDTAVYY CAR (SEQ ID NO: 209) | FDF (SEQ ID NO: 202) | (SEQ ID NO: 210) |
| h2JOVI.1-H | QVQLVQS GAEVKKP GASVKVS CKASGYT FT (SEQ ID NO: 211) | GYVMH (SEQ ID NO: 200) | WVRQAP GQGLEW MG (SEQ ID NO: 212) | FINPYN DDIQSN ERFRG (SEQ ID NO: 201) | WVTMTSD KSITTAYM ELSRLRSD DTAVYYC AR (SEQ ID NO: 213) | GAGYNF DGAYRF FDF (SEQ ID NO: 202) | WGQGTL VTVSS (SEQ ID NO: 214) |
| h3JOVI.1-H | QVQLVQS GAEVKKP GSSVKVS CKASGYT FT (SEQ ID NO: 215) | GYVMH (SEQ ID NO: 200) | WVRQAP GQGLEW MG (SEQ ID NO: 216) | FINPYN DDIQSN ERFRG (SEQ ID NO: 201) | RVTITSDK STTTAYM ELSSLRSE DTAVYYC AR (SEQ ID NO: 217) | GAGYNF DGAYRF FDF (SEQ ID NO: 202) | WGQGTL VTVSS (SEQ ID NO: 218) |
| h4JOVI.1-H | QVQLVQS GAEVKKP GASVKVS CKASGYT FT (SEQ ID NO: 219) | GYVMH (SEQ ID NO: 200) | WVRQAP GQRLEW MG (SEQ ID NO: 220) | FINPYN DDIQSN ERFRG (SEQ ID NO: 201) | RVTITSDK SATTAYM ELSSLRSE DTAVYYC AR (SEQ ID NO: 221) | GAGYNF DGAYRF FDF (SEQ ID NO: 202) | WGQGTL VTVSS (SEQ ID NO: 222) |

TABLE 2B

Exemplary heavy chain CDRs and FWRs of TRBC1-targeting antigen binding domains derived from JOVI.1 shown in Table 2A (according to ABM numbering convention)

| Ab ID | VHFWR1 | VHCDR1 | VHFWR2 | VHCDR2 | VHFWR3 | VHCDR3 | VHFWR4 |
|---|---|---|---|---|---|---|---|
| mJOVI.1-H | EVRLQQS GPDLIKP GASVKM SCKAS (SEQ ID NO: 8400) | GYTFTG YVMH (SEQ ID NO: 8401) | WVKQRP GQGLEWI G (SEQ ID NO: 204) | FINPYN DDIQSN ERFRG (SEQ ID NO: 201) | KATLTSDK SSTTAYME LSSLTSEDS AVYYCAR (SEQ ID NO: 205) | GAGYNF DGAYRF FDF (SEQ ID NO: 202) | WGQGTT LTVSS (SEQ ID NO: 206) |
| h1JOVI.1-H | QVQLVQ SGAEVK KPGASVK VSCKAS (SEQ ID NO: 8402) | GYTFTG YVMH (SEQ ID NO: 8401) | WVRQAP GQGLEW MG (SEQ ID NO: 208) | FINPYN DDIQSN ERFRG (SEQ ID NO: 201) | RVTMTSDK STTTAYME LSSLRSEDT AVYYCAR (SEQ ID NO: 209) | GAGYNF DGAYRF FDF (SEQ ID NO: 202) | WGQGTL VTVSS (SEQ ID NO: 210) |
| h2JOVI.1-H | QVQLVQ SGAEVK KPGASVK VSCKAS (SEQ ID NO: 8403) | GYTFTG YVMH (SEQ ID NO: 8401) | WVRQAP GQGLEW MG (SEQ ID NO: 212) | FINPYN DDIQSN ERFRG (SEQ ID NO: 201) | WVTMTSD KSITTAYM ELSRLRSD DTAVYYC AR (SEQ ID NO: 213) | GAGYNF DGAYRF FDF (SEQ ID NO: 202) | WGQGTL VTVSS (SEQ ID NO: 214) |
| h3JOVI.1-H | QVQLVQ SGAEVK KPGSSVK VSCKAS (SEQ ID NO: 8404) | GYTFTG YVMH (SEQ ID NO: 8401) | WVRQAP GQGLEW MG (SEQ ID NO: 216) | FINPYN DDIQSN ERFRG (SEQ ID NO: 201) | RVTITSDKS TTTAYMEL SSLRSEDT AVYYCAR (SEQ ID NO: 217) | GAGYNF DGAYRF FDF (SEQ ID NO: 202) | WGQGTL VTVSS (SEQ ID NO: 218) |
| h4JOVI.1-H | QVQLVQ SGAEVK KPGASVK VSCKAS (SEQ ID NO: 8405) | GYTFTG YVMH (SEQ ID NO: 8401) | WVRQAP GQRLEW MG (SEQ ID NO: 220) | FINPYN DDIQSN ERFRG (SEQ ID NO: 201) | RVTITSDKS ATTAYMEL SSLRSEDT AVYYCAR (SEQ ID NO: 221) | GAGYNF DGAYRF FDF (SEQ ID NO: 202) | WGQGTL VTVSS (SEQ ID NO: 222) |

TABLE 3A

Exemplary heavy chain CDRs and FWRs of TRBC1-targeting antigen binding domains derived from JOVI.1 (according to the Kabat numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| mJOVI.1-H | EVRLQQSGPDLIKPGASVKMSCKASGYTFT (SEQ ID NO: 7370) | GYVMH (SEQ ID NO: 7346) | WVKQRPGQGLEWIG (SEQ ID NO: 204) | FINPYNDDIQSNERFRG (SEQ ID NO: 201) | KATLTSDKSSTTAYMELSSLTSEDSAVYYCAR (SEQ ID NO: 205) | GAGYNFDGAYRFFDF (SEQ ID NO: 202) | WGQGTTLTVSS (SEQ ID NO: 206) |
| h1JOVI.1-H | QVQLVQSGAEVKKPGASVKVSCKASGYTFT (SEQ ID NO: 7348) | GYVMH (SEQ ID NO: 7346) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GAGYNFDGAYRFFDF (SEQ ID NO: 202) | WGQGTLVTVSS (SEQ ID NO: 210) |
| h2JOVI.1-H | QVQLVQSGAEVKKPGASVKVSCKASGYTFT (SEQ ID NO: 7348) | GYVMH (SEQ ID NO: 7346) | WVRQAPGQGLEWMG (SEQ ID NO: 212) | FINPYNDDIQSNERFRG (SEQ ID NO: 201) | WVTMTSDKSITTAYMELSRLRSDDTAVYYCAR (SEQ ID NO: 213) | GAGYNFDGAYRFFDF (SEQ ID NO: 202) | WGQGTLVTVSS (SEQ ID NO: 214) |
| h3JOVI.1-H | QVQLVQSGAEVKKPGSSVKVSCKASGYTFT (SEQ ID NO: 7345) | GYVMH (SEQ ID NO: 7346) | WVRQAPGQGLEWMG (SEQ ID NO: 216) | FINPYNDDIQSNERFRG (SEQ ID NO: 201) | RVTITSDKSTTTAYMELSSLRSEDTAVYYCAR (SEQ ID NO: 217) | GAGYNFDGAYRFFDF (SEQ ID NO: 202) | WGQGTLVTVSS (SEQ ID NO: 218) |
| h4JOVI.1-H | QVQLVQSGAEVKKPGASVKVSCKASGYTFT (SEQ ID NO: 7348) | GYVMH (SEQ ID NO: 7346) | WVRQAPGQRLEWMG (SEQ ID NO: 220) | FINPYNDDIQSNERFRG (SEQ ID NO: 201) | RVTITSDKSATTAYMELSSLRSEDTAVYYCAR (SEQ ID NO: 221) | GAGYNFDGAYRFFDF (SEQ ID NO: 202) | WGQGTLVTVSS (SEQ ID NO: 222) |
| h5JOVI.1-H | QVQLVQSGAEVKKPGSSVKVSCKASGYTFT (SEQ ID NO: 7345) | GYVMH (SEQ ID NO: 7346) | WVRQAPGQGLEWMG (SEQ ID NO: 208) | FINPYNDDIQSNERFRG (SEQ ID NO: 201) | RVTITSDKSTTTAYMELSSLRSEDTAVYYCAR (SEQ ID NO: 217) | GAGYNFDGAYRFFDF (SEQ ID NO: 202) | WGQGTTVTVSS (SEQ ID NO: 7347) |
| h6JOVI.1-H | QVQLVQSGAEVKKPGASVKVSCKASGYTFT (SEQ ID NO: 7348) | GYVMH (SEQ ID NO: 7346) | WVRQAPGQGLEWMG (SEQ ID NO: 208) | FINPYNDDIQSNERFRG (SEQ ID NO: 201) | RVTMTSDKSITTAYMELSRLRSDDTAVYYCAR (SEQ ID NO: 7349) | GAGYNFDGAYRFFDF (SEQ ID NO: 202) | WGQGTTVTVSS (SEQ ID NO: 7347) |
| H1 germlined-VH | QVQLVQSGAEVKKPGSSVKVSCKASGYTFS (SEQ ID NO: 7353) | GYAIS (SEQ ID NO: 7354) | WVRQAPGQGLEWMG (SEQ ID NO: 208) | FINPYNDDIQSNERFRG (SEQ ID NO: 201) | RVTITSDKSTTTAYMELSSLRSEDTAVYYCAR (SEQ ID NO: 217) | GAGYNFDGAYRFFDF (SEQ ID NO: 202) | WGQGTLVTVSS (SEQ ID NO: 210) |
| H2 germlined-VH | QVQLVQSGAEVKKPGSSVKVSCKASGYTFT (SEQ ID NO: 7345) | GYVMH (SEQ ID NO: 7346) | WVRQAPGQGLEWMG (SEQ ID NO: 208) | FIIPIFGTANYAQKFQG (SEQ ID NO: 7355) | RVTITSDKSTTTAYMELSSLRSEDTAVYYCAR (SEQ ID NO: 217) | GAGYNFDGAYRFFDF (SEQ ID NO: 202) | WGQGTLVTVSS (SEQ ID NO: 210) |
| H1/H2 germlined-VH | QVQLVQSGAEVKKPGSSVKVSCKASGYTFS (SEQ ID NO: 7353) | GYAIS (SEQ ID NO: 7354) | WVRQAPGQGLEWMG (SEQ ID NO: 208) | FIIPIFGTANYAQKFQG (SEQ ID NO: 7355) | RVTITSDKSTTTAYMELSSLRSEDTAVYYCAR (SEQ ID NO: 217) | GAGYNFDGAYRFFDF (SEQ ID NO: 202) | WGQGTLVTVSS (SEQ ID NO: 210) |

TABLE 3B

Exemplary heavy chain CDRs and FWRs of TRBC1-targeting antigen binding domains derived from JOVI.1 of Table 3A (according to the ABM numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| mJOVI.1-H | EVRLQQSGPDLIKPGASVKMSCKAS (SEQ ID NO: 8506) | GYTFTGYVMH (SEQ ID NO: 8507) | WVKQRPGQGLEWIG (SEQ ID NO: 204) | FINPYNDDIQSNERFRG (SEQ ID NO: 201) | KATLTSDKSSTTAYMELSSLTSEDSAVYYCAR (SEQ ID NO: 205) | GAGYNFDGAYRFFDF (SEQ ID NO: 202) | WGQGTTLTVSS (SEQ ID NO: 206) |
| h1JOVI.1-H | QVQLVQSGAEVKKPGASVKVSCKAS (SEQ ID NO: 8508) | GYTFTGYVMH (SEQ ID NO: 8507) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GAGYNFDGAYRFFDF (SEQ ID NO: 202) | WGQGTLVTVSS (SEQ ID NO: 210) |
| h2JOVI.1-H | QVQLVQSGAEVKKPGASVKVSCKAS (SEQ ID NO: 8508) | GYTFTGYVMH (SEQ ID NO: 8507) | WVRQAPGQGLEWMG (SEQ ID NO: 212) | FINPYNDDIQSNERFRG (SEQ ID NO: 201) | WVTMTSDKSITTAYMELSRLRSDDTAVYYCAR (SEQ ID NO: 213) | GAGYNFDGAYRFFDF (SEQ ID NO: 202) | WGQGTLVTVSS (SEQ ID NO: 214) |
| h3JOVI.1-H | QVQLVQSGAEVKKPGSSVKVSCKAS (SEQ ID NO: 8509) | GYTFTGYVMH (SEQ ID NO: 8507) | WVRQAPGQGLEWMG (SEQ ID NO: 216) | FINPYNDDIQSNERFRG (SEQ ID NO: 201) | RVTITSDKSTTTAYMELSSLRSEDTAVYYCAR (SEQ ID NO: 217) | GAGYNFDGAYRFFDF (SEQ ID NO: 202) | WGQGTLVTVSS (SEQ ID NO: 218) |
| h4JOVI.1-H | QVQLVQSGAEVKKPGASVKVSCKAS (SEQ ID NO: 8508) | GYTFTGYVMH (SEQ ID NO: 8507) | WVRQAPGQRLEWMG (SEQ ID NO: 220) | FINPYNDDIQSNERFRG (SEQ ID NO: 201) | RVTITSDKSATTAYMELSSLRSEDTAVYYCAR (SEQ ID NO: 221) | GAGYNFDGAYRFFDF (SEQ ID NO: 202) | WGQGTLVTVSS (SEQ ID NO: 222) |
| h5JOVI.1-H | QVQLVQSGAEVKKPGSSVKVSCKAS (SEQ ID NO: 8510) | GYTFTGYVMH (SEQ ID NO: 8507) | WVRQAPGQGLEWMG (SEQ ID NO: 208) | FINPYNDDIQSNERFRG (SEQ ID NO: 201) | RVTITSDKSTTTAYMELSSLRSEDTAVYYCAR (SEQ ID NO: 217) | GAGYNFDGAYRFFDF (SEQ ID NO: 202) | WGQGTTVTVSS (SEQ ID NO: 7347) |
| h6JOVI.1-H | QVQLVQSGAEVKKPGASVKVSCKAS (SEQ ID NO: 8511) | GYTFTGYVMH (SEQ ID NO: 8507) | WVRQAPGQGLEWMG (SEQ ID NO: 208) | FINPYNDDIQSNERFRG (SEQ ID NO: 201) | RVTMTSDKSITTAYMELSRLRSDDTAVYYCAR (SEQ ID NO: 7349) | GAGYNFDGAYRFFDF (SEQ ID NO: 202) | WGQGTTVTVSS (SEQ ID NO: 7347) |
| H1 germlined-VH | QVQLVQSGAEVKKPGSSVKVSCKAS (SEQ ID NO: 8512) | GYTFSGYAIS (SEQ ID NO: 8513) | WVRQAPGQGLEWMG (SEQ ID NO: 208) | FINPYNDDIQSNERFRG (SEQ ID NO: 201) | RVTITSDKSTTTAYMELSSLRSEDTAVYYCAR (SEQ ID NO: 217) | GAGYNFDGAYRFFDF (SEQ ID NO: 202) | WGQGTLVTVSS (SEQ ID NO: 210) |
| H2 germlined-VH | QVQLVQSGAEVKKPGSSVKVSCKAS (SEQ ID NO: 8514) | GYTFTGYVMH (SEQ ID NO: 8507) | WVRQAPGQGLEWMG (SEQ ID NO: 208) | FIIPIFGTANYAQKFQG (SEQ ID NO: 7355) | RVTITSDKSTTTAYMELSSLRSEDTAVYYCAR (SEQ ID NO: 217) | GAGYNFDGAYRFFDF (SEQ ID NO: 202) | WGQGTLVTVSS (SEQ ID NO: 210) |
| H1/H2 germlined-VH | QVQLVQSGAEVKKPGSSVKVSCKAS (SEQ ID NO: 8515) | GYTFSGYAIS (SEQ ID NO: 8513, 8516) | WVRQAPGQGLEWMG (SEQ ID NO: 208) | FIIPIFGTANYAQKFQG (SEQ ID NO: 7355) | RVTITSDKSTTTAYMELSSLRSEDTAVYYCAR (SEQ ID NO: 217) | GAGYNFDGAYRFFDF (SEQ ID NO: 202) | WGQGTLVTVSS (SEQ ID NO: 210) |

TABLE 4

Exemplary light chain CDRs and FWRs of TKBC1-targeting antigen binding domains derived from JOVI.1 (According to Kabat numbering scheme)

| Ab ID | VLFWR1 | VLCDR1 | VLFWR2 | VLCDR2 | VLFWR3 | VLCDR3 | VLFWR4 |
|---|---|---|---|---|---|---|---|
| mJOVI.1-L | DVVMTQSPLSLPVSLGDQASISC (SEQ ID NO: 226) | RSSQRLVHSNGNTYLH (SEQ ID NO: 223) | WYLQKPGQSPKLLIY (SEQ ID NO: 227) | RVSNRFP (SEQ ID NO: 224) | GVPDRFSGSGSGTDFTLKISRVEAEDLGIYFC (SEQ ID NO: 228) | SQSTHVPYT (SEQ ID NO: 225) | FGGGTKLEIK (SEQ ID NO: 229) |
| h1JOVI.1-L | DVVMTQSPLSLPVTPGEPASISC (SEQ ID NO: 230) | RSSQRLVHSNGNTYLH (SEQ ID NO: 223) | WYLQKPGQSPQLLIY (SEQ ID NO: 231) | RVSNRFP (SEQ ID NO: 224) | GVPDRFSGSGSGTDFTLKISRVEAEDVGVYFC (SEQ ID NO: 232) | SQSTHVPYT (SEQ ID NO: 225) | FGGGTKVEIK (SEQ ID NO: 233) |
| h2JOVI.1-L | EVVMTQSPGTLSLSPGERATLSC (SEQ ID NO: 234) | RSSQRLVHSNGNTYLH (SEQ ID NO: 223) | WYQQKPGQAPRLLIY (SEQ ID NO: 235) | RVSNRFP (SEQ ID NO: 224) | GIPDRFSGSGSGTDFTLTISRLEPEDFAVYFC (SEQ ID NO: 236) | SQSTHVPYT (SEQ ID NO: 225) | FGGGTKVEIK (SEQ ID NO: 237) |
| h3JOVI.1-L | DVVMTQSPLSLPVTLGQPASISC (SEQ ID NO: 238) | RSSQRLVHSNGNTYLH (SEQ ID NO: 223) | WYQQRPGQSPRLLIY (SEQ ID NO: 239) | RVSNRFP (SEQ ID NO: 224) | GVPDRFSGSGSGTDFTLKISRVEAEDVGVYFC (SEQ ID NO: 240) | SQSTHVPYT (SEQ ID NO: 225) | FGGGTKVEIK (SEQ ID NO: 241) |
| h4JOVI.1-L | DVVMTQTPLSLPVTPGEPASISC (SEQ ID NO: 242) | RSSQRLVHSNGNTYLH (SEQ ID NO: 223) | WYLQKPGQSPQLLIY (SEQ ID NO: 243) | RVSNRFP (SEQ ID NO: 224) | GVPDRFSGSGSGTDFTLKISRVEAEDVGVYFC (SEQ ID NO: 244) | SQSTHVPYT (SEQ ID NO: 225) | FGGGTKVEIK (SEQ ID NO: 245) |
| h5JOVI.1-L | DVVMTQTPLSLSVTPGQPASISC (SEQ ID NO: 246) | RSSQRLVHSNGNTYLH (SEQ ID NO: 223) | WYLQKPGQSPQLLIY (SEQ ID NO: 247) | RVSNRFP (SEQ ID NO: 224) | GVPDRFSGSGSGTDFTLKISRVEAEDVGVYFC (SEQ ID NO: 248) | SQSTHVPYT (SEQ ID NO: 225) | FGGGTKVEIK (SEQ ID NO: 249) |
| L1 germlined-VL | DVVMTQSPLSLPVTLGQPASISC (SEQ ID NO: 238) | RSSQSLVYSDGNTYH (SEQ ID NO: 7367) | WYQQRPGQSPRLLIY (SEQ ID NO: 239) | RVSNRFP (SEQ ID NO: 224) | GVPDRFSGSGSGTDFTLKISRVEAEDVGVYFC (SEQ ID NO: 232) | SQSTHVPYT (SEQ ID NO: 225) | FGGGTKVEIK (SEQ ID NO: 233) |
| L2 germlined-VL | DVVMTQSPLSLPVTLGQPASISC (SEQ ID NO: 238) | RSSQRLVHSNGNTYLH (SEQ ID NO: 223) | WYQQRPGQSPRLLIY (SEQ ID NO: 239) | KVSNRDS (SEQ ID NO: 7368) | GVPDRFSGSGSGTDFTLKISRVEAEDVGVYFC (SEQ ID NO: 232) | SQSTHVPYT (SEQ ID NO: 225) | FGGGTKVEIK (SEQ ID NO: 233) |
| L3 germlined-VL | DVVMTQSPLSLPVTLGQPASISC (SEQ ID NO: 238) | RSSQRLVHSNGNTYLH (SEQ ID NO: 223) | WYQQRPGQSPRLLIY (SEQ ID NO: 239) | RVSNRFP (SEQ ID NO: 224) | GVPDRFSGSGSGTDFTLKISRVEAEDVGVYFC (SEQ ID NO: 232) | MQSTHWPYT (SEQ ID NO: 7369) | FGGGTKVEIK (SEQ ID NO: 233) |
| L1/L2/L3 germlined-VL | DVVMTQSPLSLPVTLGQPASISC (SEQ ID NO: 238) | RSSQSLVYSDGNTYH (SEQ ID NO: 7367) | WYQQRPGQSPRLLIY (SEQ ID NO: 239) | KVSNRDS (SEQ ID NO: 7368) | GVPDRFSGSGSGTDFTLKISRVEAEDVGVYFC (SEQ ID NO: 232) | MQSTHWPYT (SEQ ID NO: 7369) | FGGGTKVEIK (SEQ ID NO: 233) |

TABLE 5A

Exemplary heavy chain CDRs and FWRs of TRBC1-targeting antigen binding domains (According to Kabat numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| BKM0191 | QVQLVQ SGAEVK KPGSSVK VSCKASG YTFT (SEQ ID NO: 215) | GYVMH (SEQ ID NO: 200) | WVRQAP GQGLEW MG (SEQ ID NO: 208) | FIIPIFGT ANYAQK FQG (SEQ ID NO: 7355) | RVTITSD KSTTTA YMELSS LRSEDT AVYYCA R (SEQ ID NO: 217) | GAGYNF DGAYRF FDF (SEQ ID NO: 202) | WGQGTL VTVSS (SEQ ID NO: 210) |
| BKM0192 | QVQLVQ SGAEVK KPGSSVK VSCKASG YTFT (SEQ ID NO: 215) | GYVMH (SEQ ID NO: 200) | WVRQAP GOGLEW MG (SEQ ID NO: 208) | FIIPIFGT ANYAQK FQG (SEQ ID NO: 7355) | RVTITSD KSTTTA YMELSS LRSEDT AVYYCA R (SEQ ID NO: 217) | GAGYNF DGAYRE FDF (SEQ ID NO: 202) | WGQGTL VTVSS (SEQ ID NO: 210) |
| BKM0193 | QVQLVQ SGAEVK KPGSSVK VSCKASG YTFT (SEQ ID NO: 215) | GYVMH (SEQ ID NO: 200) | WVRQAP GQGLEW MG (SEQ ID NO: 208) | FIIPIFGT ANYAQK FQG (SEQ ID NO: 7355) | RVTITSD KSTTTA YMELSS LRSEDT AVYYCA R (SEQ ID NO: 217) | GAGYNF DGAYRF FDF (SEQ ID NO: 202) | WGQGTL VTVSS (SEQ ID NO: 210) |
| BKM0194 | QVQLVQ SGAEVK KPGSSVK VSCKASG YTFT (SEQ ID NO: 215) | GYVMH (SEQ ID NO: 200) | WVRQAP GQGLEW MG (SEQ ID NO: 208) | FIIPIFGT ANYAQK FQG (SEQ ID NO: 7355) | RVTITSD KSTTTA YMELSS LRSEDT AVYYCA R (SEQ ID NO: 217) | GAGYNF DGAYRF FDF (SEQ ID NO: 202) | WGQGTL VTVSS (SEQ ID NO: 210) |
| BKM0195 | QVQLVQ SGAEVK KPGSSVK VSCKASG YTFT (SEQ ID NO: 215) | GYVMH (SEQ ID NO: 200) | WVRQAP GQGLEW MG (SEQ ID NO: 208) | FIIPIFGT ANYAQK FQG (SEQ ID NO: 7355) | RVTITSD KSTTTA YMELSS LRSEDT AVYYCA R (SEQ ID NO: 217) | GAGYNF DGAYRF FDF (SEQ ID NO: 202) | WGQGTL VTVSS (SEQ ID NO: 210) |
| BKM0196 | QVQLVQ SGAEVK KPGSSVK VSCKASG YTFT (SEQ ID NO: 215) | GYVMH (SEQ ID NO: 200) | WVRQAP GOGLEW MG (SEQ ID NO: 208) | FIPIFGT ANYAQK FQG (SEQ ID NO: 7355) | RVTITSD KSTTTA YMELSS LRSEDT AVYYCA R (SEQ ID NO: 217) | GAGYNF DGAYRF FDF (SEQ ID NO: 202) | WGQGTL VTVSS (SEQ ID NO: 210) |

TABLE 5B

Exemplary heavy chain CDRs and FWRs of TRBC1-targeting antigen binding domains of Table 5A (According to ABM numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| BKM0191 | QVQLVQ SGAEVK KPGSSVK VSCKAS (SEQ ID NO: 8516) | GYTFTG YVMH (SEQ ID NO: 8517) | WVRQAP GQGLEW MG (SEQ ID NO: 208) | FIIPIFGT ANYAQ KFQG (SEQ ID NO: 7355) | RVTITSDK STTTAYM ELSSLRSE DTAVYYC AR (SEQ ID NO: 217) | GAGYNF DGAYRF FDF (SEQ ID NO: 202) | WGQGTL VTVSS (SEQ ID NO: 210) |

TABLE 5B-continued

Exemplary heavy chain CDRs and FWRs of TRBC1-targeting antigen binding domains of Table 5A (According to ABM numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| BKM0192 | QVQLVQ SGAEVK KPGSSVK VSCKAS (SEQ ID NO: 8518) | GYTFTG YVMH (SEQ ID NO: 8519) | WVRQAP GQGLEW MG (SEQ ID NO: 208) | FIIPIFGT ANYAQ KFQG (SEQ ID NO: 7355) | RVTITSDK STTTAYM ELSSLRSE DTAVYYC AR (SEQ ID NO: 217) | GAGYNF DGAYRF FDF (SEQ ID NO: 202) | WGQGTL VTVSS (SEQ ID NO: 210) |
| BKM0193 | QVQLVQ SGAEVK KPGSSVK VSCKAS (SEQ ID NO: 8520) | GYTFTG YVMH (SEQ ID NO: 8521) | WVRQAP GQGLEW MG (SEQ ID NO: 208) | FUPIFGT ANYAQ KFOG (SEQ ID NO: 7355) | RVTITSDK STTTAYM ELSSLRSE DTAVYYC AR (SEQ ID NO: 217) | GAGYNF DGAYRF FDF (SEQ ID NO: 202) | WGQGTL VTVSS (SEQ ID NO: 210) |
| BKM0194 | QVQLVQ SGAEVK KPGSSVK VSCKAS (SEQ ID NO: 8522) | GYTFTG YVMH (SEQ ID NO: 8523) | WVRQAP GQGLEW MG (SEQ ID NO: 208) | FIIPIFGT ANYAQ KFQG (SEQ ID NO: 7355) | RVTITSDK STTTAYM ELSSLRSE DTAVYYC AR (SEQ ID NO: 217) | GAGYNF DGAYRF FDF (SEQ ID NO: 202) | WGQGTL VTVSS (SEQ ID NO: 210) |
| BKM0195 | QVQLVQ SGAEVK KPGSSVK VSCKAS (SEQ ID NO: 8524) | GYTFTG YVMH (SEQ ID NO: 8525) | WVRQAP GQGLEW MG (SEQ ID NO: 208) | FIIPIFGT ANYAQ KFQG (SEQ ID NO: 7355) | RVTITSDK STTTAYM ELSSLRSE DTAVYYC AR (SEQ ID NO: 217) | GAGYNF DGAYRF FDF (SEQ ID NO: 202) | WGQGTL VTVSS (SEQ ID NO: 210) |
| BKM0196 | QVQLVQ SGAEVK KPGSSVK VSCKAS (SEQ ID NO: 8526) | GYTFTG YVMH (SEQ ID NO: 8527) | WVRQAP GQGLEW MG (SEQ ID NO: 208) | FIIPIFGT ANYAQ KFQG (SEQ ID NO: 7355) | RVTITSDK STTTAYM ELSSLRSE DTAVYYC AR (SEQ ID NO: 217) | GAGYNF DGAYRE FDF (SEQ ID NO: 202) | WGQGTL VTVSS (SEQ ID NO: 210) |

TABLE 6

Exemplary light chain CDRs and FWRs of TRBC1-targeting antigen binding domains (According to Kabat numbering scheme)

| Ab ID | VLFWR1 | VLCDR1 | VLFWR2 | VLCDR2 | VLFWR3 | VLCDR3 | VLFWR4 |
|---|---|---|---|---|---|---|---|
| BKM0 191 | DVVMTQS PLSLPVTL GQPASISC (SEQ ID NO: 238) | RSSQRLV HSNANT YLH (SEQ ID NO: 8673) | WYQQRP GQSPRL LIY (SEQ ID NO: 239) | *RVSNRFP* (SEQ ID NO: 224) | GVPDRFSG SGSGTDFT LKISRVEA EDVGVYF C (SEQ ID NO: 232) | SQSTHVP YTF (SEQ ID NO: 8674) | GGGTKV EIK (SEQ ID NO: 8675) |
| BKM0 192 | DVVMTQS PLSLPVTL GQPASISC (SEQ ID NO: 238) | RSSQRLV HSNGNA YLH (SEQ ID NO: 8676) | WYQQRP GQSPRL LIY (SEQ ID NO: 239) | *RVSNRFP* (SEQ ID NO: 224) | GVPDRFSG SGSGTDFT LKISRVEA EDVGVYF C (SEQ ID NO: 232) | SQSTHVP YTF (SEQ ID NO: 8674) | GGGTKV EIK (SEQ ID NO: 8675) |
| BKM0 193 | DVVMTQS PLSLPVTL GQPASISC (SEQ ID NO: 238) | RSSQRLV HSNANA YLH (SEQ ID NO: 8677) | WYQQRP GQSPRL LIY (SEQ ID NO: 239) | *RVSNRFP* (SEQ ID NO: 224) | GVPDRFSG SGSGTDFT LKISRVEA EDVGVYF C (SEQ ID NO: 232) | SQSTHVP YT (SEQ ID NO: 225) | FGGGTK VEIK (SEQ ID NO: 233) |
| BKM0 194 | DVVMTQS PLSLPVTL GQPASISC (SEQ ID NO: 238) | RSSQRLV HSGGNT YLH (SEQ ID NO: 8678) | WYQQRP GQSPRL LIY (SEQ ID NO: 239) | *RVSNRFP* (SEQ ID NO: 224) | GVPDRFSG SGSGTDFT LKISRVEA EDVGVYF C (SEQ ID NO: 232) | SQSTHVP YT (SEQ ID NO: 225) | FGGGTK VEIK (SEQ ID NO: 233) |

TABLE 6-continued

| Exemplary light chain CDRs and FWRs of TRBC1-targeting antigen binding domains (According to Kabat numbering scheme) | | | | | | | |
|---|---|---|---|---|---|---|---|
| Ab ID | VLFWR1 | VLCDR1 | VLFWR2 | VLCDR2 | VLFWR3 | VLCDR3 | VLFWR4 |
| BKM0 195 | DVVMTQS PLSLPVTL GQPASISC (SEQ ID NO: 238) | RSSQRLV HSNGSTY LH (SEQ ID NO: 8679) | WYQQRP GQSPRL LIY (SEQ ID NO: 239) | *RVSNRFP* (SEQ ID NO: 224) | GVPDRFSG SGSGTDFT LKISRVEA EDVGVYF C (SEQ ID NO: 232) | SQSTHVP YT (SEQ ID NO: 225) | FGGGTK VEIK (SEQ ID NO: 233) |
| BKM0 196 | DVVMTQS PLSLPVTL GQPASISC (SEQ ID NO: 238) | RSSQRLV HSGGSTY LH (SEQ ID NO: 8680) | WYQQRP GQSPRL LIY (SEQ ID NO: 239) | *RVSNRFP* (SEQ ID NO: 224) | GVPDRFSG SGSGTDFT LKISRVEA EDVGVYF C (SEQ ID NO: 232) | SQSTHVP YT (SEQ ID NO: 225) | FGGGTK VEIK (SEQ ID NO: 233) |

TABLE 7

| Exemplary variable regions of TRBC1-targeting antigen binding domains | | | |
|---|---|---|---|
| SEQ ID NO | Ab ID | Description | Sequence |
| SEQ ID NO: 250 | mJOVI.1-H | JOVI.1 heavy chain variable region | EVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSS |
| SEQ ID NO: 251 | h1JOVI.1-H | JOVI.1 heavy chain variable region humanized variant 1 | QVQLVQSGAEVKKPGASVKVSCKASGYTFTGYVMHWVRQAPGQGLEWMGFINPYNDDIQSNERFRGRVTMTSDKSTTTAYMELSSLRSEDTAVYYCARGAGYNFDGAYRFFDFWGQGTLVTVSS |
| SEQ ID NO: 252 | h2JOVI.1-H | JOVI.1 heavy chain variable region humanized variant 2 | QVQLVQSGAEVKKPGASVKVSCKASGYTFTGYVMHWVRQAPGQGLEWMGFINPYNDDIQSNERFRGWVTMTSDKSITTAYMELSRLRSDDTAVYYCARGAGYNFDGAYRFFDFWGQGTLVTVSS |
| SEQ ID NO: 253 | h3JOVI.1-H | JOVI.1 heavy chain variable region humanized variant 3 | QVQLVQSGAEVKKPGSSVKVSCKASGYTFTGYVMHWVRQAPGQGLEWMGFINPYNDDIQSNERFRGRVTITSDKSTTTAYMELSSLRSEDTAVYYCARGAGYNFDGAYRFFDFWGQGTLVTVSS |
| SEQ ID NO: 254 | h4JOVI.1-H | JOVI.1 heavy chain variable region humanized variant 4 | QVQLVQSGAEVKKPGASVKVSCKASGYTFTGYVMHWVRQAPGQRLEWMGFINPYNDDIQSNERFRGRVTITSDKSATTAYMELSSLRSEDTAVYYCARGAGYNFDGAYRFFDFWGQGTLVTVSS |
| SEQ ID NO: 7343 | h5JOVI.1-H | JOVI.1 heavy chain variable region humanized variant 5 | QVQLVQSGAEVKKPGSSVKVSCKASGYTFTGYVMHWVRQAPGQGLEWMGFINPYNDDIQSNERFRGRVTITSDKSTTTAYMELSSLRSEDTAVYYCARGAGYNFDGAYRFFDFWGQGTTVTVSS |
| SEQ ID NO: 7344 | h6JOVI.1-H | JOVI.1 heavy chain variable region humanized variant 6 | QVQLVQSGAEVKKPGASVKVSCKASGYTFTGYVMHWVRQAPGQGLEWMGFINPYNDDIQSNERFRGRVTMTSDKSITTAYMELSRLRSDDTAVYYCARGAGYNFDGAYRFFDFWGQGTTVTVSS |
| SEQ ID NO: 7350 | H1 germlined-VH | JOVI.1 heavy chain variable region humanized H1 | QVQLVQSGAEVKKPGSSVKVSCKASGYTFSGYAISWVRQAPGQGLEWMGFINPYNDDIQSNERFRGRVTITSDKSTTTAYMELSSLRSEDTAVYYCARGAGYNFDGAYRFFDFWGQGTLVTVSS |
| SEQ ID NO: 7351 | H2 germlined-VH | JOVI.1 heavy chain variable region humanized H2 | QVQLVQSGAEVKKPGSSVKVSCKASGYTFTGYVMHWVRQAPGQGLEWMGFIIPIFGTANYAQKFQGRVTITSDKSTTTAYMELSSLRSEDTAVYYCARGAGYNFDGAYRFFDFWGQGTLVTVSS |
| SEQ ID NO: 7352 | H1/H2 germlined-VH | JOVI.1 heavy chain variable region humanized H1/H2 | QVQLVQSGAEVKKPGSSVKVSCKASGYTFSGYAISWVRQAPGQGLEWMGFIIPIFGTANYAQKFQGRVTITSDKSTTTAYMELSSLRSEDTAVYYCARGAGYNFDGAYRFFDFWGQGTLVTVSS |

TABLE 7-continued

Exemplary variable regions of TRBC1-targeting antigen binding domains

| SEQ ID NO | Ab ID | Description | Sequence |
|---|---|---|---|
| SEQ ID NO: 255 | mJOVI.1-L | JOVI.1 light chain variable region | DVVMTQSPLSLPVSLGDQASISCRSSQRLVHSNG NTYLHWYLQKPGQSPKLLIYRVSNRFPGVPDRFS GSGSGTDFTLKISRVEAEDLGIYFCSQSTHVPYTF GGGTKLEIK |
| SEQ ID NO: 7351 | BKM0191 VH | BKM0191 G29A heavy chain variable region | QVQLVQSGAEVKKPGSSVKVSCKASGYTFTGYV MHWVRQAPGQGLEWMGFIIPIFGTANYAQKFQG RVTITSDKSTTTAYMELSSLRSEDTAVYYCARGA GYNFDGAYRFFDFWGQGTLVTVSS |
| SEQ ID NO: 7351 | BKM0192 VH | BKM0192 T31A heavy chain variable region | QVQLVQSGAEVKKPGSSVKVSCKASGYTFTGYV MHWVRQAPGQGLEWMGFIIPIFGTANYAQKFQG RVTITSDKSTTTAYMELSSLRSEDTAVYYCARGA GYNFDGAYRFFDFWGQGTLVTVSS |
| SEQ ID NO: 7351 | BKM0193 VH | BKM0193 G29a T31A heavy chain variable region | QVQLVQSGAEVKKPGSSVKVSCKASGYTFTGYV MHWVRQAPGQGLEWMGFIIPIFGTANYAQKFQG RVTITSDKSTTTAYMELSSLRSEDTAVYYCARGA GYNFDGAYRFFDFWGQGTLVTVSS |
| SEQ ID NO: 7351 | BKM0194 VH | BKM0194 N28G heavy chain variable region | QVQLVQSGAEVKKPGSSVKVSCKASGYTFTGYV MHWVRQAPGQGLEWMGFIIPIFGTANYAQKFQG RVTITSDKSTTTAYMELSSLRSEDTAVYYCARGA GYNFDGAYRFFDFWGQGTLVTVSS |
| SEQ ID NO: 7351 | BKM0195 VH | BKM0195 N30S heavy chain variable region | QVQLVQSGAEVKKPGSSVKVSCKASGYTFTGYV MHWVRQAPGQGLEWMGFIIPIFGTANYAQKFQG RVTITSDKSTTTAYMELSSLRSEDTAVYYCARGA GYNFDGAYRFFDFWGQGTLVTVSS |
| SEQ ID NO: 7351 | BKM0196 VH | BKM0196 N28G N30S heavy chain variable region | QVQLVQSGAEVKKPGSSVKVSCKASGYTFTGYV MHWVRQAPGQGLEWMGFIIPIFGTANYAQKFQG RVTITSDKSTTTAYMELSSLRSEDTAVYYCARGA GYNFDGAYRFFDFWGQGTLVTVSS |
| SEQ ID NO: 256 | h1JOVI.1-L | JOVI.1 light chain variable region humanized variant 1 | DVVMTQSPLSLPVTPGEPASISCRSSQRLVHSNGN TYLHWYLQKPGQSPQLLIYRVSNRFPGVPDRFSG SGSGTDFTLKISRVEAEDVGVYFCSQSTHVPYTF GGGTKVEIK |
| SEQ ID NO: 257 | h2JOVI.1-L | JOVI.1 light chain variable region humanized variant 2 | EVVMTQSPGTLSLSPGERATLSCRSSQRLVHSNG NTYLHWYQQKPGQAPRLLIYRVSNRFPGIPDRFS GSGSGTDFTLTISRLEPEDFAVYFCSQSTHVPYTF GGGTKVEIK |
| SEQ ID NO: 258 | h3JOVI.1-L | JOVI.1 light chain variable region humanized variant 3 | DVVMTQSPLSLPVTLGQPASISCRSSQRLVHSNG NTYLHWYQQRPGQSPRLLIYRVSNRFPGVPDRFS GSGSGTDFTLKISRVEAEDVGVYFCSQSTHVPYT FGGGTKVEIK |
| SEQ ID NO: 259 | h4JOVI.1-L | JOVI.1 light chain variable region humanized variant 4 | DVVMTQTPLSLPVTPGEPASISCRSSQRLVHSNG NTYLHWYLQKPGQSPQLLIYRVSNRFPGVPDRFS GSGSGTDFTLKISRVEAEDVGVYFCSQSTHVPYT FGGGTKVEIK |
| SEQ ID NO: 260 | h5JOVI.1-L | JOVI.1 light chain variable region humanized variant 5 | DVVMTQTPLSLSVTPGQPASISCRSSQRLVHSNG NTYLHWYLQKPGQSPQLLIYRVSNRFPGVPDRFS GSGSGTDFTLKISRVEAEDVGVYFCSQSTHVPYT FGGGTKVEIK |
| SEQ ID NO: 7357 | L1 germlined-VL | JOVI.1 light chain variable region humanized L1 | DVVMTQSPLSLPVTLGQPASISCRSSQSLVYSDG NTYHWYQQRPGQSPRLLIYRVSNRFPGVPDRFSG SGSGTDFTLKISRVEAEDVGVYFCSQSTHVPYTF GGGTKVEIK |
| SEQ ID NO: 7358 | L2 germlined-VL | JOVI.1 light chain variable region humanized L2 | DVVMTQSPLSLPVTLGQPASISCRSSQRLVHSNG NTYLHWYQQRPGQSPRLLIYKVSNRDSGVPDRFS GSGSGTDFTLKISRVEAEDVGVYFCSQSTHVPYT FGGGTKVEIK |
| SEQ ID NO: 7359 | L3 germlined-VL | JOVI.1 light chain variable region humanized L3 | DVVMTQSPLSLPVTLGQPASISCRSSQRLVHSNG NTYLHWYQQRPGQSPRLLIYRVSNRFPGVPDRFS GSGSGTDFTLKISRVEAEDVGVYFCMQSTHWPY TFGGGTK VEIK |

TABLE 7-continued

Exemplary variable regions of TRBC1-targeting antigen binding domains

| SEQ ID NO | Ab ID | Description | Sequence |
| --- | --- | --- | --- |
| SEQ ID NO: 7360 | L1/L2/L3 germlined-VL | JOVI.1 light chain variable region humanized L1/L2/L3 | DVVMTQSPLSLPVTLGQPASISCRSSQSLVYSDGNTYHWYQQRPGQSPRLLIYKVSNRDSGVPDRFSGSGSGTDFTLKISRVEAEDVGVYFCMQSTHWPYTFGGGTKVEIK |
| SEQ ID NO: 8681 | BKM0191 VL | BKM0191 G29A light chain variable region | DVVMTQSPLSLPVTLGQPASISCRSSQRLVHSNANTYLHWYQQRPGQSPRLLIYRVSNRFPGVPDRFSGSGSGTDFTLKISRVEAEDVGVYFCSQSTHVPYTFGGGTKVEIK |
| SEQ ID NO: 8682 | BKM0192 VL | BKM0192 T31A light chain variable region | DVVMTQSPLSLPVTLGQPASISCRSSQRLVHSNGNAYLHWYQQRPGQSPRLLIYRVSNRFPGVPDRFSGSGSGTDFTLKISRVEAEDVGVYFCSQSTHVPYTFGGGTKVEIK |
| SEQ ID NO: 8683 | BKM0193 VL | BKM0193 G29a T31A light chain variable region | DVVMTQSPLSLPVTLGQPASISCRSSQRLVHSNANAYLHWYQQRPGQSPRLLIYRVSNRFPGVPDRFSGSGSGTDFTLKISRVEAEDVGVYFCSQSTHVPYTFGGGTKVEIK |
| SEQ ID NO: 8684 | BKM0194 VL | BKM0194 N28G light chain variable region | DVVMTQSPLSLPVTLGQPASISCRSSQRLVHSGGNTYLHWYQQRPGQSPRLLIYRVSNRFPGVPDRFSGSGSGTDFTLKISRVEAEDVGVYFCSQSTHVPYTFGGGTKVEIK |
| SEQ ID NO: 8685 | BKM0195 VL | BKM0195 N30S light chain variable region | DVVMTQSPLSLPVTLGQPASISCRSSQRLVHSNGSTYLHWYQQRPGQSPRLLIYRVSNRFPGVPDRFSGSGSGTDFTLKISRVEAEDVGVYFCSQSTHVPYTFGGGTKVEIK |
| SEQ ID NO: 8686 | BKM0196 VL | BKM0196 N28G N30S light chain variable region | DVVMTQSPLSLPVTLGQPASISCRSSQRLVHSGGSTYLHWYQQRPGQSPRLLIYRVSNRFPGVPDRFSGSGSGTDFTLKISRVEAEDVGVYFCSQSTHVPYTFGGGTKVEIK |

TABLE 8

Exemplary TRBC1-targeting antigen binding domains/antibody molecules

| SEQ ID NO | Ab ID | Description | Sequence |
| --- | --- | --- | --- |
| SEQ ID NO: 6154 | Ch(anti-TRBC1)HC N297A | Anti-TRBC1 heavy chain | EVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK |
| SEQ ID NO: 6155 | Ch(anti-TRBC1)HC | Anti-TRBC1 heavy chain | EVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK |
| SEQ ID NO: 6156 | Ch(anti-TRBC1) LC | Anti-TRBC1 light chain, e.g., a LC Fab | DVVMTQSPLSLPVSLGDQASISCRSSQRLVHSNGNTYLHWYLQKPGQSPKLLIY*RVSNRFP*GVPDRFSGSGSGTDFTLKISRVEAEDLGIYFCSQSTHVPYTFGGGTKLEIKRTVAAPSVFIFPPSDEQLKSGTASVVCLLNNFYP |

TABLE 8-continued

Exemplary TRBC1-targeting antigen binding domains/antibody molecules

| SEQ ID NO | Ab ID | Description | Sequence |
|---|---|---|---|
| | | | REAKVQWKVDNALQSGNSQESVTEQDSKDSTYSLS STLTLSKADYEKHKVYACEVTHQGLSSPVTKSFNR GEC |
| SEQ ID NO: 6191 | Ch(anti-TRBC1)HC | Anti-TRBC1 heavy chain, e.g., a HC Fab | EVRLQQSGPDLIKPGASVKMSCKASGYTFTGYVMH WVKQRPGQGLEWIGFINPYNDDIQSNERFRGKATLT SDKSSTTAYMELSSLTSEDSAVYYCARGAGYNFDG AYRFFDFWGQGTTLTVSSASTKGPSVFPLAPSSKSTS GGTAALGCLVKDYFPEPVTVSWNSGALTSGVHTFP AVLQSSGLYSLSSVVTVPSSSLGTQTYICNVNHKPS NTKVDKRVEPKSC |
| SEQ ID NO: 6167 | a_hTRBC1_Jovi1_Hum5_VH-hCHIg_Hole_Cys-Blank | Anti-TRBC1 heavy chain | METDTLLLWVLLLWVPGSTGQVQLVQSGAEVKKP GSSVKVSCKASGYTFTGYVMHWVRQAPGQGLEW MGFINPYNDDIQSNERFRGRVTITSDKSTTTAYMEL SSLRSEDTAVYYCARGAGYNFDGAYRFFDFWGQG TLVTVSSASTKGPSVFPLAPSSKSTSGGTAALGCLV KDYFPEPVTVSWNSGALTSGVHTFPAVLQSSGLYSL SSVVTVPSSSLGTQTYICNVNHKPSNTKVDKRVEPK SCDKTHTCPPCPAPELLGGPSVFLFPPKPKDTLMISR TPEVTCVVVDVSHEDPEVKFNWYVDGVEVHNAKT KPREEQYNSTYRVVSVLTVLHQDWLNGKEYKCKV SNKALPAPIEKTISKAKGQPREPQVCTLPPSREEMTK NQVSLSCAVKGFYPSDIAVEWESNGQPENNYKTTPP VLDSDGSFFLVSKLTVDKSRWQQGNVFSCSVMHEA LHNHYTQKSLSLSPGK |
| SEQ ID NO: 6168 | a_hTRBC1_Jovi1_Hum5_VH-hCHIg-Blank | Anti-TRBC1 heavy chain | METDTLLLWVLLLWVPGSTGQVQLVQSGAEVKKP GSSVKVSCKASGYTFTGYVMHWVRQAPGQGLEW MGFINPYNDDIQSNERFRGRVTITSDKSTTTAYMEL SSLRSEDTAVYYCARGAGYNFDGAYRFFDFWGQG TLVTVSSASTKGPSVFPLAPSSKSTSGGTAALGCLV KDYFPEPVTVSWNSGALTSGVHTFPAVLQSSGLYSL SSVVTVPSSSLGTQTYICNVNHKPSNTKVDKRVEPK SCDKTHTCPPCPAPELLGGPSVFLFPPKPKDTLMISR TPEVTCVVVDVSHEDPEVKFNWYVDGVEVHNAKT KPREEQYNSTYRVVSVLTVLHQDWLNGKEYKCKV SNKALPAPIEKTISKAKGQPREPQVYTLPPSREEMTK NQVSLTCLVKGFYPSDIAVEWESNGQPENNYKTTPP VLDSDGSFFLYSKLTVDKSRWQQGNVFSCSVMHEA LHNHYTQKSLSLSPGK |
| SEQ ID NO: 6169 | a_hTRBC1_Jovi1_Hum3_VL-hCLIg_vk-Blank | Anti-TRBC1 light chain | METDTLLLWVLLLWVPGSTGDVVMTQSPLSLPVTL GQPASISCRSSQRLVHSNGNTYLHWYQQRPGQSPRL LIYRVSNRFPGVPDRFSGSGSGTDFTLKISRVEAEDV GVYFCSQSTHVPYTFGGGTKVEIKRTVAAPSVFIFPP SDEQLKSGTASVVCLLNNFYPREAKVQWKVDNAL QSGNSQESVTEQDSKDSTYSLSSTLTLSKADYEKHK VYACEVTHQGLSSPVTKSFNRGEC |

TRBC2 Antigen Binding Domains

In some embodiments, the antigen binding domain that binds to TRBC2 comprises one or more CDRs (e.g., VHCDR1, VHCDR2, VHCDR3, VLCDR1, VLCDR2, and/or VLCDR3) disclosed in Table 9 or Table 10, or a sequence having at least 85%, 90%, 95%, or 99% identity thereto. In some embodiments, the antigen binding domain that binds to TRBC2 comprises one or more framework regions (e.g., VHFWR1, VHFWR2, VHFWR3, VHFWR4, VLFWR1, VLFWR2, VLFWR3, and/or VLFWR4) disclosed in Table 9 or Table 10, or a sequence having at least 85%, 90%, 95%, or 99% identity thereto. In some embodiments, the antigen binding domain that binds to TRBC2 comprises a VH and/or a VL disclosed in Table 11, or a sequence having at least 85%, 90%, 95%, or 99% identity thereto. In some embodiments, the antigen binding domain that binds to TRBC2 comprises an amino acid sequence disclosed in Table 12, or a sequence having at least 85%, 90%, 95%, or 99% identity thereto.

In some embodiments, the antigen binding domain that binds to TRBC2 comprises a VH comprising a heavy chain complementarity determining region 1 (VHCDR1), a VHCDR2, and a VHCDR3, and a VL comprising a light chain complementarity determining region 1 (VLCDR1), a VLCDR2, and a VLCDR3.

In some embodiments, the VHCDR1, VHCDR2, and VHCDR3 comprise the amino acid sequences of SEQ ID NOs: 7441, 201, and 7442, respectively (or a sequence having at least 85%, 90%, 95%, or 99% identity thereto). In some embodiments, the VHCDR1, VHCDR2, and VHCDR3 comprise the amino acid sequences of SEQ ID NOs: 7422, 201, and 7403, respectively (or a sequence having at least 85%, 90%, 95%, or 99% identity thereto). In some embodiments, the VHCDR1, VHCDR2, and VHCDR3 comprise the amino acid sequences of SEQ ID NOs: 7401, 201, and 7403, respectively (or a sequence having at least 85%, 90%, 95%, or 99% identity thereto). In some embodiments, the VHCDR1, VHCDR2, and VHCDR3 comprise the amino acid sequences of SEQ ID NOs: 7394, 201, and 7396, respectively (or a sequence having at least 85%, 90%, 95%, or 99% identity thereto). In some embodiments, the VHCDR1, VHCDR2, and VHCDR3 comprise the amino acid sequences of SEQ ID NOs: 7346, 201, and 7398, respectively (or a sequence having at least 85%, 90%, 95%, or 99% identity thereto). In some embodiments, the VHCDR1, VHCDR2, and VHCDR3 comprise the amino acid sequences of SEQ ID NOs: 7346, 201, and 7400, respectively (or a sequence having at least 85%, 90%, 95%, or 99% identity thereto). In some embodiments, the VHCDR1, VHCDR2, and VHCDR3 comprise the amino acid sequences of SEQ ID NOs: 7405, 201, and 7403, respectively (or a sequence having at least 85%, 90%, 95%, or 99% identity thereto). In some embodiments, the VHCDR1, VHCDR2, and VHCDR3 comprise the amino acid sequences of SEQ ID NOs: 7407, 201, and 7403, respectively (or a sequence having at least 85%, 90%, 95%, or 99% identity thereto). In some embodiments, the VHCDR1, VHCDR2, and VHCDR3 comprise the amino acid sequences of SEQ ID NOs: 7427, 201, and 7403, respectively (or a sequence having at least 85%, 90%, 95%, or 99% identity thereto). In some embodiments, the VHCDR1, VHCDR2, and VHCDR3 comprise the amino acid sequences of SEQ ID NOs: 7430, 201, and 7403, respectively (or a sequence having at least 85%, 90%, 95%, or 99% identity thereto).

In some embodiments, the VLCDR1, VLCDR2, and VLCDR3 comprise the amino acid sequences of SEQ ID NOs: 7443, 224, and 225, respectively (or a sequence having at least 85%, 90%, 95%, or 99% identity thereto). In some embodiments, the VLCDR1, VLCDR2, and VLCDR3 comprise the amino acid sequences of SEQ ID NOs: 7410, 224, and 225, respectively (or a sequence having at least 85%, 90%, 95%, or 99% identity thereto). In some embodiments, the VLCDR1, VLCDR2, and VLCDR3 comprise the amino acid sequences of SEQ ID NOs: 7409, 224, and 225, respectively (or a sequence having at least 85%, 90%, 95%, or 99% identity thereto).

In some embodiments, the VHCDR1, VHCDR2, VHCDR3, VLCDR1, VLCDR2, and VLCDR3 comprise the amino acid sequences of SEQ ID NOs: 7441, 201, 7442, 7443, 224, and 225, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 7422, 201, 7403, 7410, 224, and 225, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 7401, 201, 7403, 7410, 224, and 225, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of: SEQ ID NOs: 7394, 201, 7396, 7410, 224, and 225, respectively (or a sequence having at least 85%, 90%, 95%, or 99% identity thereto); SEQ ID NOs: 7346, 201, 7398, 7410, 224, and 225, respectively (or a sequence having at least 85%, 90%, 95%, or 99% identity thereto); SEQ ID NOs: 7346, 201, 7400, 7410, 224, and 225, respectively (or a sequence having at least 85%, 90%, 95%, or 99% identity thereto); SEQ ID NOs: 7405, 201, 7403, 7410, 224, and 225, respectively (or a sequence having at least 85%, 90%, 95%, or 99% identity thereto); SEQ ID NOs: 7407, 201, 7403, 7410, 224, and 225, respectively (or a sequence having at least 85%, 90%, 95%, or 99% identity thereto); SEQ ID NOs: 7427, 201, 7403, 7410, 224, and 225, respectively (or a sequence having at least 85%, 90%, 95%, or 99% identity thereto); SEQ ID NOs: 7430, 201, 7403, 7410, 224, and 225, respectively (or a sequence having at least 85%, 90%, 95%, or 99% identity thereto); SEQ ID NOs: 7422, 201, 7403, 7409, 224, and 225, respectively (or a sequence having at least 85%, 90%, 95%, or 99% identity thereto); SEQ ID NOs: 7401, 201, 7403, 7409, 224, and 225, respectively (or a sequence having at least 85%, 90%, 95%, or 99% identity thereto); SEQ ID NOs: 7394, 201, 7396, 7409, 224, and 225, respectively (or a sequence having at least 85%, 90%, 95%, or 99% identity thereto); SEQ ID NOs: 7346, 201, 7398, 7409, 224, and 225, respectively (or a sequence having at least 85%, 90%, 95%, or 99% identity thereto); SEQ ID NOs: 7346, 201, 7400, 7409, 224, and 225, respectively (or a sequence having at least 85%, 90%, 95%, or 99% identity thereto); SEQ ID NOs: 7405, 201, 7403, 7409, 224, and 225, respectively (or a sequence having at least 85%, 90%, 95%, or 99% identity thereto); SEQ ID NOs: 7407, 201, 7403, 7409, 224, and 225, respectively (or a sequence having at least 85%, 90%, 95%, or 99% identity thereto); SEQ ID NOs: 7427, 201, 7403, 7409, 224, and 225, respectively (or a sequence having at least 85%, 90%, 95%, or 99% identity thereto); or SEQ ID NOs: 7430, 201, 7403, 7409, 224, and 225, respectively (or a sequence having at least 85%, 90%, 95%, or 99% identity thereto).

In some embodiments, the VH comprises an amino acid sequence selected from the group consisting of SEQ ID NOs: 7420, 7423, 7411, 7412, 7413, 7414, 7415, 7416, 7417, 7425, 7428, and 7431 (or a sequence having at least 85%, 90%, 95%, or 99% identity thereto) and/or the VL comprises an amino acid sequence selected from the group consisting of SEQ ID NOs: 7419 and 7418 (or a sequence having at least 85%, 90%, 95%, or 99% identity thereto). In some embodiments, the VH and VL comprise the amino acid sequences of SEQ ID NOs: 7420 and 7419, respectively (or a sequence having at least 85%, 90%, 95%, or 99% identity thereto). In some embodiments, the VH and VL comprise the amino acid sequences of SEQ ID NOs: 7423 and 7419, respectively (or a sequence having at least 85%, 90%, 95%, or 99% identity thereto). In some embodiments, the VH and VL comprise the amino acid sequences of SEQ ID NOs: 7411 and 7419, respectively (or a sequence having at least 85%, 90%, 95%, or 99% identity thereto). In some embodiments, the $V_H$ and VL comprise the amino acid sequences of SEQ ID NOs: 7412 and 7419, respectively (or a sequence having at least 85%, 90%, 95%, or 99% identity thereto). In some embodiments, the VH and VL comprise the amino acid sequences of SEQ ID NOs: 7413 and 7419, respectively (or a sequence having at least 85%, 90%, 95%, or 99% identity thereto). In some embodiments, the VH and VL comprise the amino acid sequences of SEQ ID NOs: 7414 and 7419, respectively (or a sequence having at least 85%, 90%, 95%, or 99% identity thereto). In some embodiments, the VH and VL comprise the amino acid sequences of SEQ ID NOs: 7415 and 7419, respectively (or a sequence having at least 85%, 90%, 95%, or 99% identity thereto). In some embodiments, the VH and VL comprise the amino acid sequences of SEQ ID NOs: 7416 and 7419, respectively (or a sequence having at least 85%, 90%, 95%, or 99% identity thereto). In some embodiments, the VH and VL comprise the amino acid sequences of SEQ ID NOs: 7417 and 7419, respectively (or a sequence having at least 85%, 90%, 95%, or 99% identity thereto). In some embodiments, the VH and VL comprise the amino acid sequences of SEQ ID NOs: 7425 and 7419, respectively (or a sequence having at least 85%, 90%, 95%, or 99% identity thereto). In some embodiments, the VH and VL comprise the amino acid sequences of SEQ ID NOs: 7428 and 7419, respectively (or a sequence having at least 85%, 90%, 95%, or 99% identity thereto). In some embodiments, the VH and VL comprise the amino acid sequences of SEQ ID NOs: 7431 and 7419, respectively (or a sequence having at least 85%, 90%, 95%, or 99% identity thereto). In some embodiments, the VH and VL comprise the amino acid sequences of SEQ ID NOs: 7420 and 7418, respectively (or a sequence having at least 85%, 90%, 95%, or 99% identity thereto). In some embodiments, the VH and VL comprise the amino acid sequences of SEQ ID NOs: 7423 and 7418, respectively (or a sequence having at least 85%, 90%, 95%, or 99% identity thereto). In some embodiments, the VH and VL comprise the amino acid sequences of SEQ ID NOs: 7411 and 7418, respectively (or a sequence having at least 85%, 90%, 95%, or 99% identity thereto). In some embodiments, the VH and VL comprise the amino acid sequences of SEQ ID NOs: 7412 and 7418, respectively (or a sequence having at least 85%, 90%, 95%, or 99% identity thereto). In some embodiments, the VH and VL comprise the amino acid sequences of SEQ ID NOs: 7413 and 7418, respectively (or a sequence having at least 85%, 90%, 95%, or 99% identity thereto). In some embodiments, the VH and VL comprise the amino acid sequences of SEQ ID NOs: 7414 and 7418, respectively (or a sequence having at least 85%, 90%, 95%, or 99% identity thereto). In some embodiments, the VH and VL comprise the amino acid sequences of SEQ ID NOs: 7415 and 7418, respectively (or a sequence having at least 85%, 90%, 95%, or 99% identity thereto). In some embodiments, the VH and VL comprise the amino acid sequences of SEQ ID NOs: 7416 and 7418, respectively (or a sequence having at least 85%, 90%, 95%, or 99% identity thereto). In some embodiments, the VH and VL comprise the amino acid sequences of SEQ ID NOs: 7417 and 7418, respectively (or a sequence having at least 85%, 90%, 95%, or 99% identity thereto). In some embodiments, the VH and VL comprise the amino acid sequences of SEQ ID NOs: 7425 and 7418, respectively (or a sequence having at least 85%, 90%, 95%, or 99% identity thereto). In some embodiments, the VH and VL comprise the amino acid sequences of SEQ ID NOs: 7428 and 7418, respectively (or a sequence having at least 85%, 90%, 95%, or 99% identity thereto). In some embodiments, the VH and VL comprise the amino acid sequences of SEQ ID NOs: 7431 and 7418, respectively (or a sequence having at least 85%, 90%, 95%, or 99% identity thereto).

In some embodiments, the antigen binding domain that binds to TRBC2 comprises an amino acid sequence selected from the group consisting of SEQ ID NOs: 7433, 7434, 7435, 7436, and 7437 (or a sequence having at least 85%, 90%, 95%, or 99% identity thereto).

TABLE 9A

Exemplary heavy chain CDRs and FWRs of TRBC2-targeting antigen binding domains (According to Kabat numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| JVD3-VH | QVQLVQSGAEVKKPGASVKVSCKASGYTFP (SEQ ID NO: 7393) | GFVMH (SEQ ID NO: 7394) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGMWFDGAYRFFDF (SEQ ID NO: 7396) | WGQGTLVTVSS (SEQ ID NO: 210) |
| JVD4-VH | QVQLVQSGAEVKKPGASVKVSCKASGYPFH (SEQ ID NO: 7397) | GYVMH (SEQ ID NO: 7346) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKNFDGAYRFFDF (SEQ ID NO: 7398) | WGQGTLVTVSS (SEQ ID NO: 210) |
| JVD5-VH | QVQLVQSGAEVKKPGASVKVSCKASGYTYP (SEQ ID NO: 7399) | GYVMH (SEQ ID NO: 7346) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWFDGAYRFFDF (SEQ ID NO: 7400) | WGQGTLVTVSS (SEQ ID NO: 210) |
| JVD6-VH | QVQLVQSGAEVKKPGASVKVSCKASNQNFH (SEQ ID NO: 7402, 7401) | GYHMH (SEQ ID NO: 7401) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWGDGAYRFFDF (SEQ ID NO: 7403) | WGQGTLVTVSS (SEQ ID NO: 210) |
| JVD7-VH | QVQLVQSGAEVKKPGASVKVSCKASSQNFH (SEQ ID NO: 7404) | GFYMH (SEQ ID NO: 7405) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWGDGAYRFFDF (SEQ ID NO: 7403) | WGQGTLVTVSS (SEQ ID NO: 210) |

TABLE 9A-continued

Exemplary heavy chain CDRs and FWRs of TRBC2-targeting antigen binding domains (According to Kabat numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| JVD8-VH | QVQLVQSGAEVKKPGASVKVSCKASYQDFH (SEQ ID NO: 7406) | GYKMH (SEQ ID NO: 7407) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWGDGAYRFFDF (SEQ ID NO: 7403) | WGQGTLVTVSS (SEQ ID NO: 210) |
| JVD9-VH | QVQLVQSGAEVKKPGASVKVSCKASGYNFH (SEQ ID NO: 7408) | GFYMH (SEQ ID NO: 7405) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWGDGAYRFFDF (SEQ ID NO: 7403) | WGQGTLVTVSS (SEQ ID NO: 210) |
| BKM0097 anti-TRBC2 VH; BJM1184 VH | QVQLVQSGAEVKKPGASVKVSCKASTSGFH (SEQ ID NO: 7421) | GYPMH (SEQ ID NO: 7422) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWGDGAYRFFDF (SEQ ID NO: 7403) | WGQGTLVTVSS (SEQ ID NO: 210) |
| BKM0098 anti-TRBC2 VH; BJM1185 VH | QVQLVQSGAEVKKPGASVKVSCKASPRGFH (SEQ ID NO: 7424) | GYHMH (SEQ ID NO: 7401) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWGDGAYRFFDF (SEQ ID NO: 7403) | WGQGTLVTVSS (SEQ ID NO: 210) |
| BJM1186 VH | QVQLVQSGAEVKKPGASVKVSCKASFQDFH (SEQ ID NO: 7426) | GYAMH (SEQ ID NO: 7427) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWGDGAYRFFDF (SEQ ID NO: 7403) | WGQGTLVTVSS (SEQ ID NO: 210) |
| BJM1187 VH | QVQLVQSGAEVKKPGASVKVSCKASSKDFH (SEQ ID NO: 7429) | GFAMH (SEQ ID NO: 7430) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWGDGAYRFFDF (SEQ ID NO: 7403) | WGQGTLVTVSS (SEQ ID NO: 210) |
| BC2_YR3_B11-scFv VH | QVQLVQSGAEVKKPGASVKVSCKASPKGFH (SEQ ID NO: 7432) | GYHMH (SEQ ID NO: 7401) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWGDGAYR (SEQ ID NO: 7403) | WGQGTLVTVSS (SEQ ID NO: 210) |
| Consensus VHCDR | | GX1X2MH, wherein X1 is Y or F, and X2 is P, H, V, Y, K, or A (SEQ ID NO: 7441) | | FINPYNDDIQSNERFRG (SEQ ID NO: 201) | | GNGX1X2X3DGAYRFFDF, wherein X1 is K or M, X2 is W or N, and X3 is Gor F (SEQ ID NO: 7442) | |

TABLE 9B

Exemplary heavy chain CDRs and FWRs of TRBC2-targeting antigen binding domains of Table 9A (According to ABM numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| JVD3-VH | QVQLVQSGAEVKKPGASVKVSCKAS (SEQ ID NO: 8528) | GYTFPGFVMH (SEQ ID NO: 8529) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGMWFDGAYRFFDF (SEQ ID NO: 7396) | WGQGTLVTVSS (SEQ ID NO: 210) |
| JVD4-VH | QVQLVQSGAEVKKPGASVKVSCKAS (SEQ ID NO: 8530) | GYPFHGYVMH (SEQ ID NO: 8531) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKNFDGAYRFFDF (SEQ ID NO: 7398) | WGQGTLVTVSS (SEQ ID NO: 210) |
| JVD5-VH | QVQLVQSGAEVKKPGASVKVSCKAS (SEQ ID NO: 8532) | GYTYPGYVMH (SEQ ID NO: 8533) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWFDGAYRFFDF (SEQ ID NO: 7400) | WGQGTLVTVSS (SEQ ID NO: 210) |
| JVD6-VH | QVQLVQSGAEVKKPGASVKVSCKAS (SEQ ID NO: 8534) | NQNFHGYHMH (SEQ ID NO: 8535) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWGDGAYRFFDF (SEQ ID NO: 7403) | WGQGTLVTVSS (SEQ ID NO: 210) |
| JVD7-VH | QVQLVQSGAEVKKPGASVKVSCKAS (SEQ ID NO: 8536) | SQNFHGFYMH (SEQ ID NO: 8537) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWGDGAYRFFDF (SEQ ID NO: 7403) | WGQGTLVTVSS (SEQ ID NO: 210) |
| JVD8-VH | QVQLVQSGAEVKKPGASVKVSCKAS (SEQ ID NO: 8538) | YQDFHGYKMH (SEQ ID NO: 8539) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWGDGAYRFFDF (SEQ ID NO: 7403) | WGQGTLVTVSS (SEQ ID NO: 210) |
| JVD9-VH | QVQLVQSGAEVKKPGASVKVSCKAS (SEQ ID NO: 8540) | GYNFHGFYMH (SEQ ID NO: 8541) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWGDGAYRFFDF (SEQ ID NO: 7403) | WGQGTLVTVSS (SEQ ID NO: 210) |
| BKM0097 anti-TRBC2 VH; BJM1184 VH | QVQLVQSGAEVKKPGASVKVSCKAS (SEQ ID NO: 8542) | TSGFHGYPMH (SEQ ID NO: 8543) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWGDGAYRFFDF (SEQ ID NO: 7403) | WGQGTLVTVSS (SEQ ID NO: 210) |
| BKM0098 anti-TRBC2 VH; BJM1185 VH | QVQLVQSGAEVKKPGASVKVSCKAS (SEQ ID NO: 8544) | PRGFHGYHMH (SEQ ID NO: 8545) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWGDGAYRFFDF (SEQ ID NO: 7403) | WGQGTLVTVSS (SEQ ID NO: 210) |
| BJM1186 VH | QVQLVQSGAEVKKPGASVKVSCKASFQDFH (SEQ ID NO: 8546) | GYAMH (SEQ ID NO: 8547) | WVRQAPGQGLEWMG (SEQ ID NO: 208) | FINPYNDDIQSNERFRG (SEQ ID NO: 201) | RVTMTSDKSTTTAYMELSSLRSEDTAVYYCAR (SEQ ID NO: 209) | GNGKWGDGAYRFFDF (SEQ ID NO: 7403) | WGQGTLVTVSS (SEQ ID NO: 210) |

TABLE 9B-continued

Exemplary heavy chain CDRs and FWRs of TRBC2-targeting antigen binding domains of Table 9A (According to ABM numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| BJM11 87 VH | QVQLVQSG AEVKKPGA SVKVSCKA S (SEQ ID NO: 8548) | SKDFHG FAMH (SEQ ID NO: 8549) | WVRQAP GQGLEW MG (SEQ ID NO: 208) | FINPYN DDIQSN ERFRG (SEQ ID NO: 201) | RVTMTSD KSTTTAY MELSSLRS EDTAVYY CAR (SEQ ID NO: 209) | GNGKW GDGAYR FFDF (SEQ ID NO: 7403) | WGQGTL VTVSS (SEQ ID NO: 210) |
| BC2_ YR3_ B11- scFv VH | QVQLVQSG AEVKKPGA SVKVSCKA S (SEQ ID NO: 8550) | PKGFHG YHMH (SEQ ID NO: 8551) | WVRQAP GQGLEW MG (SEQ ID NO: 208) | FINPYN DDIQSN ERFRG (SEQ ID NO: 201) | RVTMTSD KSTTTAY MELSSLRS EDTAVYY CAR (SEQ ID NO: 209) | GNGKW GDGAYR FFDF (SEQ ID NO: 7403) | WGQGTL VTVSS (SEQ ID NO: 210) |
| Consensus VHCDR | | GX1X2M H, wherein X1 is Y or F, and X2 is P, H, V, Y, K, or A (SEQ ID NO: 8552) | | FINPYN DDIQSN ERFRG (SEQ ID NO: 201) | | GNGXIX 2X3DGA YRFFDF, wherein X1 is K or M, X2 is W or N, and X3 is Gor F (SEQ ID NO: 7442) | |

TABLE 10

Exemplary light chain CDRs and FWRs of TRBC2-targeting antigen binding domains

| Ab ID | VLFWR1 | VLCDR1 | VLFWR2 | VLCDR2 | VLFWR3 | VLCDR3 | VLFWR4 |
|---|---|---|---|---|---|---|---|
| JVD2- VL | DVVMTQS PLSLPVTP GEPASISC (SEQ ID NO: 230) | RSSQNLV HSNGRTY LH (SEQ ID NO: 7409) | WYLQKP GQSPQL LIY (SEQ ID NO: 231) | RVSNRF P (SEQ ID NO: 224) | GVPDRFS GSGSGTD FTLKISRV EAEDVGV YFC (SEQ ID NO: 232) | SQSTHVP YT (SEQ ID NO: 225) | FGGGTK VEIK (SEQ ID NO: 233) |
| JVD34- VL | DVVMTQS PLSLPVTP GEPASISC (SEQ ID NO: 230) | RSSQNLV HSNGRTY LQ (SEQ ID NO: 7410) | WYLQKP GQSPQL LIY (SEQ ID NO: 231) | RVSNRF P (SEQ ID NO: 224) | GVPDRFS GSGSGTD FTLKISRV EAEDVGV YFC (SEQ ID NO: 232) | SQSTHVP YT (SEQ ID NO: 225) | FGGGTK VEIK (SEQ ID NO: 233) |
| Consensus LHCDR | | RSSQNLV HSNGRTY LX, wherein X is Q or H (SEQ ID NO: 7443) | | RVSNRF P (SEQ ID NO: 224) | | SQSTHVP YT (SEQ ID NO: 225) | |

TABLE 11

Exemplary variable regions of TRBC2-targeting antigen binding domains

| SEQ ID NO | Description | Sequence |
|---|---|---|
| SEQ ID NO: 7411 | JVD3-VH | QVQLVQSGAEVKKPGASVKVSCKASGYTFPGFVMHWVRQAPGQGL EWMGFINPYNDDIQSNERFRGRVTMTSDKSTTTAYMELSSLRSEDTA VYYCARGNGMWFDGAYRFFDFWGQGTLVTVSS |
| SEQ ID NO: 7412 | JVD4-VH | QVQLVQSGAEVKKPGASVKVSCKASGYPFHGYVMHWVRQAPGQG LEWMGFINPYNDDIQSNERFRGRVTMTSDKSTTTAYMELSSLRSEDT AVYYCARGNGKNFDGAYRFFDFWGQGTLVTVSS |

TABLE 11-continued

Exemplary variable regions of TRBC2-targeting antigen binding domains

| SEQ ID NO | Description | Sequence |
|---|---|---|
| SEQ ID NO: 7413 | JVD5-VH | QVQLVQSGAEVKKPGASVKVSCKASGYTYPGYVMHWVRQAPGQG LEWMGFINPYNDDIQSNERFRGRVTMTSDKSTTTAYMELSSLRSEDT AVYYCARGNGKWFDGAYRFFDFWGQGTLVTVSS |
| SEQ ID NO: 7414 | JVD6-VH | QVQLVQSGAEVKKPGASVKVSCKASNQNFHGYHMHWVRQAPGQG LEWMGFINPYNDDIQSNERFRGRVTMTSDKSTTTAYMELSSLRSEDT AVYYCARGNGKWGDGAYRFFDFWGQGTLVTVSS |
| SEQ ID NO: 7415 | JVD7-VH | QVQLVQSGAEVKKPGASVKVSCKASSQNFHGFYMHWVRQAPGQGL EWMGFINPYNDDIQSNERFRGRVTMTSDKSTTTAYMELSSLRSEDTA VYYCARGNGKWGDGAYRFFDFWGQGTLVTVSS |
| SEQ ID NO: 7416 | JVD8-VH | QVQLVQSGAEVKKPGASVKVSCKASYQDFHGYKMHWVRQAPGQG LEWMGFINPYNDDIQSNERFRGRVTMTSDKSTTTAYMELSSLRSEDT AVYYCARGNGKWGDGAYRFFDFWGQGTLVTVSS |
| SEQ ID NO: 7417 | JVD9-VH | QVQLVQSGAEVKKPGASVKVSCKASGYNFHGFYMHWVRQAPGQG LEWMGFINPYNDDIQSNERFRGRVTMTSDKSTTTAYMELSSLRSEDT AVYYCARGNGKWGDGAYRFFDFWGQGTLVTVSS |
| SEQ ID NO: 7420 | BKM0097 anti-TRBC2 VH; BJM1184 VH | QVQLVQSGAEVKKPGASVKVSCKASTSGFHGYPMHWVRQAPGQGL EWMGFINPYNDDIQSNERFRGRVTMTSDKSTTTAYMELSSLRSEDTA VYYCARGNGKWGDGAYRFFDFWGQGTLVTVSS |
| SEQ ID NO: 7423 | BKM0098 anti-TRBC2 VH; BJM1185 VH | QVQLVQSGAEVKKPGASVKVSCKASPRGFHGYHMHWVRQAPGQG LEWMGFINPYNDDIQSNERFRGRVTMTSDKSTTTAYMELSSLRSEDT AVYYCARGNGKWGDGAYRFFDFWGQGTLVTVSS |
| SEQ ID NO: 7425 | BJM1186 VH | QVQLVQSGAEVKKPGASVKVSCKASFQDFHGY AMHWVRQAPGQG LEWMGFINPYNDDIQSNERFRGRVTMTSDKSTTTAYMELSSLRSEDT AVYYCARGNGKWGDGAYRFFDFWGQGTLVTVSS |
| SEQ ID NO: 7428 | BJM1187 VH | QVQLVQSGAEVKKPGASVKVSCKASSKDFHGFAMHWVRQAPGQGL EWMGFINPYNDDIQSNERFRGRVTMTSDKSTTTAYMELSSLRSEDTA VYYCARGNGKWGDGAYRFFDFWGQGTLVTVSS |
| SEQ ID NO: 7431 | BC2_YR3_B11-scFv VH | QVQLVQSGAEVKKPGASVKVSCKASPKGFHGYHMHWVRQAPGQG LEWMGFINPYNDDIQSNERFRGRVTMTSDKSTTTAYMELSSLRSEDT AVYYCARGNGKWGDGAYRFFDFWGQGTLVTVSS |
| SEQ ID NO: 7418 | JVD2-VL | DVVMTQSPLSLPVTPGEPASISCRSSQNLVHSNGRTYLHWYLQKPGQ SPQLLIYRVSNRFPGVPDRFSGSGSGTDFTLKISRVEAEDVGVYFCSQ STHVPYTFGGGTKVEIK |
| SEQ ID NO: 7419 | JVD34-VL | DVVMTQSPLSLPVTPGEPASISCRSSQNLVHSNGRTYLQWYLQKPGQ SPQLLIYRVSNRFPGVPDRFSGSGSGTDFTLKISRVEAEDVGVYFCSQ STHVPYTFGGGTKVEIK |

TABLE 12

Exemplary TRBC2-targeting antigen binding domains/antibody molecules

| SEQ ID NO | Description | Sequence |
|---|---|---|
| SEQ ID NO: 7433 | BC2_YR3-A12-scFv (BJM1184) | QVQLVQSGAEVKKPGASVKVSCKASTSGFHGYPMHWVRQAPGQ GLEWMGFINPYNDDIQSNERFRGRVTMTSDKSTTTAYMELSSLRSE DTAVYYCARGNGKWGDGAYRFFDFWGQGTLVTVSSGGGGSGGG GSGGGGSGGGGSDVVMTQSPLSLPVTPGEPASISCRSSQNLVHSNG RTYLQWYLQKPGQSPQLLIYRVSNRFPGVPDRFSGSGSGTDFTL-KIS RVEAEDVGVYFCSQSTHVPYTFGGGTKVEIK |
| SEQ ID NO: 7434 | BC2_YR3-A5-scFv (BJM1185) | QVQLVQSGAEVKKPGASVKVSCKASPRGFHGYHMHWVRQAPGQ GLEWMGFINPYNDDIQSNERFRGRVTMTSDKSTTTAYMELSSLRSE DTAVYYCARGNGKWGDGAYRFFDFWGQGTLVTVSSGGGGSGGG GSGGGGSGGGGSDVVMTQSPLSLPVTPGEPASISCRSSQNLVHSNG |

TABLE 12-continued

Exemplary TRBC2-targeting antigen binding domains/antibody molecules

| SEQ ID NO | Description | Sequence |
|---|---|---|
| | | RTYLQWYLQKPGQSPQLLIYRVSNRFPGVPDRFSGSGSGTDFTL-KIS RVEAEDVGVYFCSQSTHVPYTFGGGTKVEIK |
| SEQ ID NO: 7435 | BC2_YR3-B3-scFv (BJM1186) | QVQLVQSGAEVKKPGASVKVSCKASFQDFHGYAMHWVRQAPGQ GLEWMGFINPYNDDIQSNERFRGRVTMTSDKSTTTAYMELSSLRSE DTAVYYCARGNGKWGDGAYRFFDFWGQGTLVTVSSGGGGSGGG GSGGGGSGGGGSDVVMTQSPLSLPVTPGEPASISCRSSQNLVHSNG RTYLQWYLQKPGQSPQLLIYRVSNRFPGVPDRFSGSGSGTDFTL-KIS RVEAEDVGVYFCSQSTHVPYTFGGGTKVEIK |
| SEQ ID NO: 7436 | BC2_YR3_B4-scFv (BJM1187) | QVQLVQSGAEVKKPGASVKVSCKASSKDFHGFAMHWVRQAPGQ GLEWMGFINPYNDDIQSNERFRGRVTMTSDKSTTTAYMELSSLRSE DTAVYYCARGNGKWGDGAYRFFDFWGQGTLVTVSSGGGGSGGG GSGGGGSGGGGSDVVMTQSPLSLPVTPGEPASISCRSSQNLVHSNG RTYLQWYLQKPGQSPQLLIYRVSNRFPGVPDRFSGSGSGTDFTL-KIS RVEAEDVGVYFCSQSTHVPYTFGGGTKVEIK |
| SEQ ID NO: 7437 | BC2_YR3_B11-scFv | QVQLVQSGAEVKKPGASVKVSCKASPKGFHGYHMHWVRQAPGQ GLEWMGFINPYNDDIQSNERFRGRVTMTSDKSTTTAYMELSSLRSE DTAVYYCARGNGKWGDGAYRFFDFWGQGTLVTVSSGGGGSGGG GSGGGGSGGGGSDVVMTQSPLSLPVTPGEPASISCRSSQNLVHSNG RTYLQWYLQKPGQSPQLLIYRVSNRFPGVPDRFSGSGSGTDFTL-KIS RVEAEDVGVYFCSQSTHVPYTFGGGTKVEIK |

In some embodiments, a bispecific antibody is contemplated herein to comprise a first antigen binding domain that binds to TRBC2. In some embodiments, an exemplary TRBC2 binding domain comprises a heavy chain and a light chain of a TRBC2 binding antibody (e.g., TRCBC2 binder-1, or TRCBC2 binder-2 or TRCBC2 binder 3, or TRCBC2 binder 4). In some embodiments, an exemplary TRBC2 binding domain comprises a heavy chain variable domain selected from SEQ ID NOs: 8011, 8013, 8020, or 8022, or a sequence that is at least 90% identical to SEQ ID NOs: 8011, 8013, 8020, or 8022; and a light chain variable domain selected from SEQ ID NOs: 8012, 8014, 8021, or 8023 or a sequence that is at least 90% identical to SEQ ID NOs: 1, 3, 31, or 33, including any combinations thereof.

In some embodiments, an exemplary TRBC2 binding domain comprises a heavy chain and a light chain of TRBC2 binding antibody e.g., TRCBC2 binder-1. In some embodiments, an exemplary TRBC2 binding domain comprises a sequence of amino acids in the heavy chain e.g., a heavy chain variable domain (VH) that is at least 90% identical to SEQ ID NO: 8011. In some embodiments, an exemplary TRBC2 binding domain comprises a heavy chain variable domain that is at least 91%, at least 92%, at least 93%, at least 94%, at least 95%, at least 96%, at least 97%, at least 98%, or at least 99% identical to SEQ ID NO: 8011. In some embodiments, the TRBC2 binding domain comprises a heavy chain comprising an amino acid sequence of SEQ ID NO: 8011.

In some embodiments, an exemplary TRBC2 binding domain comprises a sequence of amino acids in the light chain e.g., a light chain variable domain (VL) that is at least 95% identical to SEQ ID NO: 8012. In some embodiments, the light chain variable domain is at least at least 96%, at least 97%, at least 98%, or at least 99% identical to SEQ ID NO: 8012. In some embodiments, the TRBC2 binding domain comprises a light chain comprising an amino acid sequence of SEQ ID NO: 8012. In some embodiments, the bispecific antibody comprises a first antigen binding domain that binds to TRBC2 and comprises a heavy chain VH domain (SEQ ID NO: 8011) and a light chain VL domain (SEQ ID NO: 8012) of a TRBC2 binder, or a TRBC2 binder having one or more amino acid sequences described in Table 13 or Table 14, or a TRBC2 binder having any one of the domains described in Table 13 or Table 14, or one or more domains with one or more amino acid modifications relative to the amino acid sequences of domains described in Table 13 or Table 14.

In some embodiments, an exemplary TRBC2 binding domain comprises a heavy chain and a light chain of TRBC2 binding antibody e.g., TRCBC2 binder-2. In some embodiments, an exemplary TRBC2 binding domain comprises a heavy chain that is at least 95% identical to SEQ ID NO:8013. In some embodiments, an exemplary TRBC2 binding domain comprises a heavy chain that is at least 96%, at least 97%, at least 98%, or at least 99% identical to SEQ ID NO: 8013. In some embodiments, an exemplary TRBC2 binding domain comprises a light chain that is at least 95% identical to SEQ ID NO: 8014. In some embodiments, an exemplary TRBC2 binding domain comprises a light chain that is at least at least 96%, at least 97%, at least 98%, or at least 99% identical to SEQ ID NO: 8014. In some embodiments, the bispecific antibody comprises a first antigen binding domain that binds to TRBC2 that comprises a heavy chain VH (SEQ ID NO: 8013) and a light chain VL (SEQ ID NO: 8014) of a TRBC2 binder, or a TRBC2 binder having any one of the domains described in Table 13, or one or more domains with one or more amino acid modifications relative to the amino acid sequences of domains described in Table 13.

In some embodiments, an exemplary TRBC2 binding domain comprises a sequence of amino acids in the heavy chain e.g., a heavy chain variable domain (VH) that is at least 90% identical to SEQ ID NO: 8020. In some embodiments, an exemplary TRBC2 binding domain comprises a heavy chain variable domain that is at least 91%, at least 92%, at least 93%, at least 94%, at least 95%, at least 96%, at least 97%, at least 98%, or at least 99% identical to SEQ ID NO: 8020.

In some embodiments, an exemplary TRBC2 binding domain comprises a sequence of amino acids in the light chain e.g., a light chain variable domain (VL) that is at least 90% identical to SEQ ID NO: 8021. In some embodiments, an exemplary TRBC2 binding domain comprises a light chain variable domain that is at least 91%, at least 92%, at least 93%, at least 94%, at least 95%, at least 96%, at least 97%, at least 98%, or at least 99% identical to SEQ ID NO: 8021. In some embodiments, the bispecific antibody comprises a first antigen binding domain that binds to TRBC2 and comprises a heavy chain VH (SEQ ID NO: 8020) and a light chain VL (SEQ ID NO: 8021) of a TRBC2 binder, or a TRBC2 binder having any one of the domains described in Table 13, or one or more domains with one or more amino acid modifications relative to the amino acid sequences of domains described in Table 13 or Table 14.

In some embodiments, an exemplary TRBC2 binding domain comprises a sequence of amino acids in the heavy chain e.g., a heavy chain variable domain (VH) that is at least 90% identical to SEQ ID NO: 8022. In some embodiments, an exemplary TRBC2 binding domain comprises a heavy chain variable domain that is at least 91%, at least 92%, at least 93%, at least 94%, at least 95%, at least 96%, at least 97%, at least 98%, or at least 99% identical to SEQ ID NO: 8022.

In some embodiments, an exemplary TRBC2 binding domain comprises a sequence of amino acids in the light chain e.g., a light chain variable domain (VL) that is at least 90% identical to SEQ ID NO: 8023. In some embodiments, an exemplary TRBC2 binding domain comprises a light chain variable domain that is at least 91%, at least 92%, at least 93%, at least 94%, at least 95%, at least 96%, at least 97%, at least 98%, or at least 99% identical to SEQ ID NO: 8023. In some embodiments, the bispecific antibody comprises a first antigen binding domain that binds to TRBC2 and comprises a heavy chain VH (SEQ ID NO: 8022) and a light chain VL (SEQ ID NO: 8023) of a TRBC2 binder, or a TRBC2 binder having any one of the domains described in Table 13, or one or more domains with one or more amino acid modifications relative to the amino acid sequences of domains described in Table 13.

For example, a TRBC2-binding Heavy Chain domain may comprise the sequence of SEQ ID NO:8011

(SEQ ID NO: 8011)
QVQLVQSGAEVKKPGSSVKVSCKASPRGFYGYHMHWVRQAPGQGLEWMG

FINPYTNDIQYNERFRGRVTITSDESTTTAYMELSSLRSEDTAVYYCAM

GNGKWGDGAYRFFDLWGQGTLVTVSS, and a TRBC2-binding Light Chain domain may comprise the sequence of SEQ ID NO:8012.

(SEQ ID NO: 8012)
DVVMTQSPLSLPVTLGQPASISCRSSENLVHSNGRTYLQWYQQRPGQSP

RLLIYRVSNRFPGVPDRFSGSGSGTDFTLKISRVEAEDVGVYFCSQSSL

EPYTFGGGTKVEIK.

For example, a TRBC2-binding Heavy Chain domain may comprise the sequence of SEQ ID NO:8013

(SEQ ID NO: 8013)
QVQLVQSGAEVKKPGSSVKVSCKASPRGFYGYHMHWVRQAPGQGLEWMGF

INPYNNHIQYNERFRGRVTITSDESTTTAYMELSSLRSEDTAVYYCALGN

GKWGDGAYRFFDFWGQGTLVTVSS, and a TRBC2-binding Light Chain domain may comprise the sequence of SEQ ID NO: 8014.

(SEQ ID NO: 8014)
DVVMTQSPLSLPVTLGQPASISCRSSKNLVHSNGRTYLQWYQQRPGQSPR

LLIY*RVSNRFP*GVPDRFSGSGSGTDFTLKISRVEAEDVGVYFCSQSTREP

YTFGGGTKVEIK

A TRBC2-binding Heavy Chain domain may comprise the sequence of SEQ ID NO:8020

(SEQ ID NO: 8020)
QVQLVQSGAEVKKPGSSVKVSCKASPRGFYGYHMHWVRQAPGQGLEWMG*F*

*INPYNNHIQYNERFRG*RVTITSDESTTTAYMELSSLRSEDTAVYYCALGE

GKWGDGAYRFFDFWGQGTLVTVSS, and a TRBC2-binding Light Chain domain may comprise the sequence of SEQ ID NO: 8021:

(SEQ ID NO: 8021)
DVVMTQSPLSLPVTLGQPASISCRSSKNLVHSNGRTYLQWYQQRPGQSPR

LLIY*RVSNRFP*GVPDRFSGSGSGTDFTLKISRVEAEDVGVYFCSQSTREP

YTFGGGTKVEIK.

A TRBC2-binding Heavy Chain domain may comprise the sequence of SEQ ID NO:8022

(SEQ ID NO: 8022)
QVQLVQSGAEVKKPGSSVKVSCKASPRGFYGYHMHWVRQAPGQGLEW*MGF*

*INPYNNHIQYNERFRG*RVTITSDESTTTAYMELSSLRSEDTAVYYCALGA

GKWGDGAYRFFDFWGQGTLVTVSS, and a TRBC2-binding Light Chain domain may comprise the sequence of SEQ ID NO: 8023:

(SEQ ID NO: 8023)
DVVMTQSPLSLPVTLGQPASISCRSSKNLVHSNGRTYLQWYQQRPGQSPR

LLIY*RVSNRFP*GVPDRFSGSGSGTDFTLKISRVEAEDVGVYFCSQSTREP

YTFGGGTKVEIK.

In some embodiments, the TRBC2 antigen binding domain may comprise a mutation in the heavy chain variable domain, the mutation may be selected from a T28K mutation, a Y32F mutation and an A100N mutation in the VH domain compared to a VH domain of an antibody as described in SEQ ID NO: 8024 In some embodiments, the TRBC2 antigen binding domain comprises two or more mutations in the heavy chain variable domain, the mutation may be selected from a T28K mutation, a Y32F mutation and an A100N mutation in the VH domain compared to VH domain of the antibody as described in SEQ ID NO: 8024. In some embodiments, the VH domain may comprise a mutation that may be at position V2, or Y27, or G31 or R98, or Y102, or N103 or A107 with respect to SEQ ID NO: 8024. In some embodiments, the VH domain of the TRBC2 antigen binding domain may comprise a V2K or a V2R mutation compared to VH domain of the antibody as described in SEQ ID NO: 8024. In some embodiments, the VH domain of the TRBC2 antigen binding domain may comprise a Y27F, Y27M, Y27N or Y27W mutation compared to VH domain of the antibody as described in SEQ ID NO: 8024. In some embodiments, the VH domain of the TRBC2 antigen binding domain may comprise a G31K, a G31R, or a G31S mutation compared to VH domain of the antibody as described in SEQ ID NO: 8024. In some embodiments, the VH domain of the TRBC2 antigen binding domain may comprise a R98K mutation compared to VH domain of the antibody as described in SEQ ID NO: 8024. In some embodiments, the VH domain of the TRBC2 antigen binding domain may comprise a Y102F or Y102L mutation compared to VH domain of the antibody as described in SEQ ID NO: 8024. In some embodiments, the VH domain of the TRBC2 antigen binding domain may comprise a N193A, N193E, N103F, N103H, N103L, N103M, N103Q, N103S, N103W, or N103Y mutation compared to VH domain of the antibody as described in SEQ ID NO: 8024.

In some embodiments, the TRBC2 antigen binding domain may comprise a mutation in the light chain variable domain, the mutation may be at position N35, or at R55 with respect to the VL domain of an antibody as described in SEQ ID NO: 8025. In some embodiments, the VL domain of the TRBC2 antigen binding domain may comprise a N35M, N35F, N35Y, N35K or N35R mutation at position 35 with respect to the VL domain of an antibody as described in SEQ ID NO: 8025.

SEQ ID NO: 8024—Reference Antibody VH Domain:

(SEQ ID NO: 8024)
QVQLVQSGAEVKKPGASVKVSCKASGYTFTGYVMHWVRQAPGQGLEWMGF

INPYNDDIQSNERFRGRVTMTRDT SISTAYMELSRLRSDDTAVYYCARG

AGYNFDGAYRFFDFWGQGTMVTVSS.

SEQ ID NO: 8025—Reference Antibody VL Domain:

(SEQ ID NO: 8025)
DIVMTQSPLSLPVTPGEPASISCRSSQRLVHSNGNTYLHWYLQKPGQSPR

LLIYRVSNRFPGVPDRFSGSGSGTDFTLKISRVEAEDVGVYYC*SQSTHVP*

*YT*FGQGTKLEIK.

In some embodiments, the bispecific antibody comprises a second antigen binding domain that binds to NKp30. In some embodiments, an exemplary NKp30 binding domain comprises a heavy chain and a light chain of NKp30 binder 1. In some embodiments, an exemplary NKp30 binding domain comprises a heavy chain having an amino acid sequence of SEQ ID NO: 8006. In some embodiments, an exemplary NKp30 binding domain comprises a heavy chain having an amino acid sequence that is at least 90% identical to a sequence of SEQ ID NO: 8006. In some embodiments, an exemplary NKp30 binding domain comprises a heavy chain having an amino acid sequence that is at least 91%, at least 92%, at least 93%, at least 94%, at least 95%, at least 96%, at least 97%, at least 98%, or at least 99% identical to a sequence of SEQ ID NO: 8006. In some embodiments, an exemplary NKp30 binding domain comprises a light chain of SEQ ID NO: 8003. In some embodiments, an exemplary NKp30 binding domain comprises a light chain having an amino acid sequence that is at least 90% identical to a sequence of SEQ ID NO: 8003. In some embodiments, an exemplary NKp30 binding domain comprises a light chain having an amino acid sequence that is at least 91%, at least 92%, at least 93%, at least 94%, at least 95%, at least 96%, at least 97%, at least 98%, or at least 99% identical to a sequence of SEQ ID NO: 8003. In some embodiments, the bispecific antibody comprising a second antigen binding domain that binds to NKp30 comprises a heavy chain and a light chain of NKp30 binder 1, having amino acid sequences described in below.

An exemplary NKp30-binding, Heavy Chain domain may comprise the sequence of SEQ ID NO: 8030:

(SEQ ID NO: 8030)
EIQLLESGGGLVQPGGSLRLSCAVSGFSITTTGYHWNWVRQAPGKGLEWV

GYIYSSGSTSYNPSLKSRFTISRDTSKNTFYLQMNSLRAEDTAVYYCARG

DWHYFDYWGQGTMVTVSS.

An exemplary NKp30-binding, Light Chain domain may comprise the sequence of SEQ ID NO: 8031:

(SEQ ID NO: 8031)
DSVTTQSPLSLPVTLGQPASISCSGEKLSDKYVHWYQQRPGQSPRMLIYE

NDRRPSGVPDRFSGSNSGNDATLKISRVEAEDVGVYFCQFWDSTNSAVFG

GGTKVEIK

In some embodiments, an exemplary bispecific antibody comprises (i) a first antigen binding domain comprising a TRBC2 binding domain having a heavy chain sequence of SEQ ID NO: 8011, or a sequence that is at least 90% identical to SEQ ID NO: 8011; and a light chain sequence of SEQ ID NO: 8012, or a sequence that is at least 95% identical to SEQ ID NO: 8012; and (ii) a second antigen binding domain comprising a NKp30 binding domain having a heavy chain and a light chain sequence of SEQ ID NOs: 8030 and 8031 respectively.

In some embodiments, an exemplary bispecific antibody comprises (i) a first antigen binding domain comprising a TRBC2 binding domain having a heavy chain sequence of SEQ ID NO: 8013, or a sequence that is at least 95% identical to SEQ ID NO: 8013; and a light chain sequence of SEQ ID NO: 8014, or a sequence that is at least 95% identical to SEQ ID NO: 8014; and (ii) a second antigen binding domain comprising a NKp30 binding domain having a heavy chain and a light chain sequence of SEQ ID NO: 8030 and 8031 respectively.

In some embodiments, an exemplary bispecific antibody comprises (i) a first antigen binding domain comprising a TRBC2 binding domain having a heavy chain sequence of SEQ ID NO: 8011, or a sequence that is at least 90% identical to SEQ ID NO: 8011 and a light chain sequence of SEQ ID NO: 8012, or a sequence that is at least 95% identical to SEQ ID NO: 8012; and (ii) a second antigen binding domain comprising a NKp30 binding domain having a heavy chain and a light chain sequence at least 90% identical to SEQ ID NO: 8030 and at least 90% identical to SEQ ID NO: 8031 respectively.

In some embodiments, an exemplary bispecific antibody comprises (i) a first antigen binding domain comprising a TRBC2 binding domain having a heavy chain sequence of SEQ ID NO: 8013, or a sequence that is at least 95% identical to SEQ ID NO: 8013 and a light chain sequence of SEQ ID NO: 8014, or a sequence that is at least 95% identical to SEQ ID NO: 8014; and (ii) a second antigen binding domain comprising a NKp30 binding domain having a heavy chain and a light chain sequence at least 90% identical to SEQ ID NO: 8030 and at least 90% identical to SEQ ID NO: 8031 respectively.

In some embodiments, the bi-specific antibody comprising: (i) a first antigen binding domain comprising a TRBC2 binding domain that comprises a single chain variable fragment (scFv); wherein the scFv comprises a heavy chain and a light chain that are linked by a short linker, and (ii) a second antigen binding domain comprising a NKp30 binding domain that comprises a single chain variable fragment (scFv); wherein scFv comprises a heavy chain and a light chain that are linked by a short linker.

In some embodiments, the heavy chain of a TRBC2 binding domain comprises a HC CDR1, a CDR2 and a CDR3. In some embodiments, the light chain of a TRBC2 binding domain comprises a LC CDR1, a CDR2 and a CDR3. In one embodiment, the heavy chain of a TRBC2 binding domain comprises a HC CDR1 having an amino acid sequence comprising PRGFYGYHEMH (SEQ ID NO: 8272) {or PRGFYGY (SEQ ID NO: 8041 according to Chothia numbering system)} or PRGFYGYAMH (SEQ ID NO: 8672, 8272). In one embodiment, the heavy chain of a TRBC2 binding domain comprises a HC CDR1 having an amino acid sequence RSGFHGYAMH (SEQ ID NO: 8207) or PRGFHGYHMH (SEQ ID NO: 8211). In some embodiments, the heavy chain TRBC2 binding domain comprises a HC CDR-1 comprising an amino acid sequence SRSGFHGYAMH (SEQ ID NO: 8215). In some embodiments, the heavy chain TRBC2 binding domain comprises a HC CDR1 comprising an amino acid sequence PRGFYGYHMH (SEQ ID NO: 8219). In some embodiments, the heavy chain TRBC2 binding domain comprises a HC CDR1 comprising an amino acid sequence RSSQNLVHSNGRTYLH (SEQ ID NO: 8226). In one embodiment, the heavy chain of a TRBC2 binding domain comprises a HC CDR2 having an amino acid sequence MGFINPYTNDIQYNERFRG (SEQ ID NO: 8042). In one embodiment, the heavy chain of a TRBC2 binding domain comprises a HC CDR3 having an amino acid sequence GNGKWGDGAYRFFDL (SEQ ID NO: 8043). In one embodiment, the heavy chain of a TRBC2 binding domain comprises a HC CDR2 comprising an amino acid sequence FINPYNNHIQYNERFRG (SEQ ID NO: 8044) or FINPYNDDIQYNQKFQG (SEQ ID NO: 8208) or YINPYNRDIKYNQKFQG (SEQ ID NO: 8212). In some embodiments, the HC CDR2 has an amino acid sequence FINPYNHAIKYNQKFQG (SEQ ID NO: 8213). In some embodiments, the HC CDR2 has an amino acid sequence YINPYTGDIKYNERFRG (SEQ ID NO: 8217). In some embodiments, the HC CDR2 has an amino acid sequence FINPYNDDIQYNERFRG (SEQ ID NO. 8221). In some embodiments, the HC CDR2 has an amino acid sequence TINPYNAEIKYNQKFQG (SEQ ID NO: 8222). In some embodiments, the HC CDR2 has an amino acid sequence TINPYNRDIQYNQKFQG (SEQ ID NO: 8225). In some embodiments, the HC CDR2 has an amino acid sequence FINPYNRDIKYNERFRG (SEQ ID NO: 8228). In some embodiments, the HC CDR2 has an amino acid sequence AINPYTNDIKYNERFRG (SEQ ID NO: 8229). In some embodiments, the HC CDR2 has an amino acid sequence AINPYTNHIQYNERFRG (SEQ ID NO: 8230). In some embodiments, the HC CDR2 has an amino acid sequence AINPYTRAIKYNERFRG (SEQ ID NO: 8231). In some embodiments, the HC CDR2 has an amino acid sequence TINPYNGDIQYNERFRG (SEQ ID NO: 8232). In some embodiments, the H1C CDR2 has an amino acid sequence AINPYNTDIKYNERFRG (SEQ ID NO: 8233). In some embodiments, the HC CDR2 has an amino acid sequence YINPYNGAIKYNQKFQG (SEQ ID NO: 8234). In some embodiments, the HC CDR2 has an amino acid sequence AINPYNDDIQSNERFRG (SEQ ID NO: 8235). In some embodiments, the HC CDR2 has an amino acid sequence FINPYNRAIQYNQKFQG (SEQ ID NO: 8236). In some embodiments, the HC CDR2 has an amino acid sequence FINPYTNEIQYNERFRG (SEQ ID NO: 8237). In some embodiments, the HC CDR2 has an amino acid sequence YINPYNHDIQYNQKFQG (SEQ ID NO: 8671, 8237). In some embodiments, the HC CDR2 has an amino acid sequence SINPYTHDIQYNERFRG (SEQ ID NO: 8238). In some embodiments, the HC CDR2 has an amino acid sequence YINPYKNAIQYNQKFQG (SEQ ID NO: 8239). In some embodiments, the HC CDR2 has an amino acid sequence AINPYNTDIQYNERFRG (SEQ ID NO: 8240). In some embodiments, the HC CDR2 has an amino acid sequence SINPYNGDIQYNERFRG (SEQ ID NO: 8241). In some embodiments, the HC CDR2 has an amino acid sequence TINPYNHDAQYNERFRG (SEQ ID NO: 8242). In some embodiments, the HC CDR2 has an amino acid sequence AINPYNDDIKYNERFRG (SEQ ID NO: 8243). In some embodiments, the HC CDR2 has an amino acid sequence YINPYTHEIKYNERFRG (SEQ ID NO: 8245). In some embodiments, the HC CDR2 has an amino acid sequence FINPYKDDIKYNERFRG (SEQ ID NO: 8246). In some embodiments, the HC CDR2 has an amino acid sequence AINPYNDDIKYNQKFQG (SEQ ID NO: 8247). In some embodiments, the HC CDR2 has an amino acid sequence AINPYNRDIKYNERFRG (SEQ ID NO: 8248). In some embodiments, the HC CDR2 has an amino acid sequence AINPYNGDIKYNERFRG (SEQ ID NO: 8249). In some embodiments, the HC CDR2 has an amino acid sequence YINPYTRDIKYNERFRG (SEQ ID NO: 8250). In some embodiments, the HC CDR2 has an amino acid sequence TINPYNTDIKYNERFRG (SEQ ID NO: 8251). In some embodiments, the HC CDR2 has an amino acid sequence TINPYNNDIQYNERFRG (SEQ ID NO: 8252). In some embodiments, the HC CDR2 has an amino acid sequence YINPYNGNIQYNERFRG (SEQ ID NO: 8253). In some embodiments, the HC CDR2 has an amino acid sequence AINPYTNEIQYNERFRG (SEQ ID NO: 8254). In some embodiments, the HC CDR2 has an amino acid sequence SINPYNHDIKYNERFRG (SEQ ID NO: 8255). In some embodiments, the HC CDR2 has an amino acid sequence FINPYKNEIKYNERFRG (SEQ ID NO: 8256). In some embodiments, the HC CDR2 has an amino acid sequence YINPYNNEIQYNERFRGR (SEQ ID NO: 8257) or a sequence SINPYNRHIQYNERFRG (SEQ ID NO: 8258) or a sequence SINPYTREIQYNERFRG (SEQ ID NO: 8259). In some embodiments, the HC CDR2 has an amino acid sequence FINPYTNDIQYNERFRG (SEQ ID NO: 8260). In some embodiments, the HC CDR2 has an amino acid sequence AINPYTNEIKYNERFRG (SEQ ID NO: 8261). In some embodiments, the HC CDR2 has an amino acid sequence AINPYNDDIQYNERFRG (SEQ ID NO: 8263). In some embodiments, the HC CDR2 has an amino acid sequence YINPYNNDIKYNQKFQG (SEQ ID NO: 8264) or an amino acid sequence TINPYTREIQYNQKFQG (SEQ ID NO: 8266) or YINPYNNEIQYNQKFQG (SEQ ID NO: 8267). In some embodiments, the HC CDR2 has an amino acid sequence AINPYNHEIQYNQKFQG (SEQ ID NO: 8268). In some embodiments, the HC CDR2 has an amino acid sequence TINPYKHHIKYNERFRG (SEQ ID NO: 8269). In some embodiments, the HC CDR2 has an amino acid sequence FINPYTRAIKYNERFRG (SEQ ID NO: 8270). In some embodiments, the HC CDR2 has an amino acid sequence SINPYTRHIQYNERFRG (SEQ ID NO: 8273).

In one embodiment, the heavy chain of a TRBC2 binding domain comprises a HC CDR3 having an amino acid sequence GNGKWGDGAYRFFDF (SEQ ID NO: 8045). In some embodiments the heavy chain of a TRBC2 binding domain comprises a HC CDR3 having an amino acid sequence GEGKWGDGAYRFFDF (SEQ ID NO: 8046) In some embodiments the heavy chain of a TRBC2 binding domain comprises a HC CDR3 having an amino acid sequence GAGKWGDGAYRFFDF (SEQ ID NO: 8047). In some embodiments the heavy chain of a TRBC2 binding domain comprises a HC CDR3 having an amino acid sequence GNGKWGDGAYRFFDF (SEQ ID NO. 8216). In some embodiments the heavy chain of a TRBC2 binding domain comprises a HC CDR3 having an amino acid sequence GNGKWGDGAYRFFDL (SEQ ID NO. 8220). In some embodiments the heavy chain of a TRBC2 binding domain comprises a HC CDR3 having an amino acid sequence LGNGKWGDGAYRFFDL (SEQ ID NO: 8224). In some embodiments the heavy chain of a TRBC2 binding domain comprises a HC CDR3 having an amino acid sequence MGNGKWGDGAYRFFDL (SEQ ID NO: 8227). In some embodiments the heavy chain of a TRBC2 binding domain comprises a HC CDR3 having an amino acid sequence GNGKWGDGAYRFFDF (SEQ ID NO: 8244).

In one embodiment, the light chain of a TRBC2 binding domain comprises a LC CDR1 having an amino acid sequence RSSENLVHSNGRTYLQ (SEQ ID NO: 8048) or RSSQNLVHSNGRTYLQ (SEQ ID NO: 8209). In one embodiment, the light chain of a TRBC2 binding domain comprises a LC CDR1 having an amino acid sequence RSSQNLVHSNARTYLQ (SEQ ID NO: 8276). In one embodiment, the light chain of a TRBC2 binding domain comprises a LC CDR2 having an amino acid sequence RVSNRFP (SEQ ID NO: 8049). In some embodiments the light chain of a TRBC2 binding domain comprises a LC CDR2 sequence comprising RVSNRFP (SEQ ID NO: 8218).

In one embodiment, the light chain of a TRBC2 binding domain comprises a LC CDR3 having an amino acid sequence SQSSLEPYT (SEQ ID NO: 8050) or SQSSYVPFT (SEQ ID NO: 8214). In one embodiment, the light chain of a TRBC2 binding domain comprises a LC CDR3 having an amino acid sequence SQSTYEPFT (SEQ ID NO: 8223). In one embodiment, the light chain of a TRBC2 binding domain comprises a LC CDR1 having an amino acid sequence RSSKNLVHSNGRTYLQ (SEQ ID NO: 80511. In one embodiment, the light chain of a TRBC2 binding domain comprises a LC CDR1 having an amino acid sequence RSSKNLVHSNARTYLQ (SEQ ID NO: 8271). In one embodiment, the light chain of a TRBC2 binding domain comprises a LC CDR3 having an amino acid sequence SQSTREPYT (SEQ ID NO: 8052) or SQSTHVPYT (SEQ ID NO: 8210). In one embodiment, the light chain of a TRBC2 binding domain comprises a LC CDR3 having an amino acid sequence SQSTHLPYT (SEQ ID NO: 8262). In one embodiment, the light chain of a TRBC2 binding domain comprises a LC CDR3 having an amino acid sequence SQSTQEPYT (SEQ ID NO: 8265). In one embodiment, the light chain of a TRBC2 binding domain comprises a LC CDR3 having an amino acid sequence SQSSLLPYTF (SEQ ID NO: 8274). In one embodiment, the light chain of a TRBC2 binding domain comprises a LC CDR3 having an amino acid sequence SQSTLEPFT (SEQ ID NO: 8277). In one embodiment, the light chain of a TRBC2 binding domain comprises a LC CDR3 having an amino acid sequence SQSSHIPYT (SEQ ID NO: 8279). In one embodiment, the light chain of a TRBC2 binding domain comprises a LC CDR3 having an amino acid sequence SQSSLVPYT (SEQ ID NO: 8280).

In some embodiments, the heavy chain of a NKp3 binding domain comprises a HC CDR1, a CDR2 and a CDR3. In some embodiments, the light chain of a NKp3 binding domain comprises a LC CDR1, a CDR2 and a CDR3. In some, embodiments, the heavy chain of a NKp30 binding domain comprises a HC CDR1, having an amino acid sequence ITTTGYHWN (SEQ ID NO: 8053) or comprises a sequence GYHWN (SEQ ID NO:6000, according to Kabat numbering system). In some embodiments, the heavy chain of a NKp30 binding domain comprises a HC CDR2, having an amino acid sequence YVYSSGSTSYNPSLKS (SEQ ID NO: 8054). In some embodiments, the heavy chain of a RNKp3 binding domain comprises a HC CDR3, having an amino acid sequence GDWHYFDY (SEQ ID NO: 8055).

In some embodiments, the light chain of a NKp30 binding domain comprises a LC CDR1, having an amino acid sequence SGEKLSDKYVH (SEQ ID NO: 8056). In some embodiments, the light chain of a NKp30 binding domain comprises a LC CDR2, having an amino acid sequence ENDRRPS (SEQ ID NO: 8057). In some embodiments, the light chain of a NKp30 binding domain comprises a LC CDR3, having an amino acid sequence QFWDSTNSAV (SEQ ID NO: 8058).

TABLE 13

TCBC2 binding domains

| | Description | Sequence |
|---|---|---|
| TRCBC2 binder BKM0238 VH-1-SEQ ID NO: 8011 | TRBC2-binding, Heavy Chain Variable Region | QVQLVQSGAEVKKPGSSVKVSCKASPRGFYGYHMHWVRQAPGQGLEWMGFINPYTNDIQYNERFRGRVTITSDESTTTAYMELSSLRSEDTAVYYCAMGNGKWGDGAYRFFDLWGQGTLVTVSS (SEQ ID NO: 8011 ) |
| TRCBC2 binder BKM0238 VL-1 SEQ ID NO: 8012 | TRBC2-binding, Light Chain Variable Region | DVVMTQSPLSLPVTLGQPASISCRSSENLVHSNGRTYLQWYQQRPGQSPRLLIYRVSNRFPGVPDRFSGSGSGTDFTLKISRVEAEDVGVYFCSQSSLEPYTFGGGTKVEIK (SEQ ID NO: 8012) |

TABLE 13-continued

| TCBC2 binding domains | | |
|---|---|---|
| | Description | Sequence |
| TRCBC2 binder BKM240 VH-2-SEQ ID NO: 8013 | TRBC2-binding, Heavy Chain | QVQLVQSGAEVKKPGSSVKVSCKASPRGFYGYHMHWVRQAPGQGLEWMGFINPYNNHIQYNERFRGRVTITSDESTTTAYMELSSLRSEDTAVYYCALGNGKWGDGAYRFFDFWGQGTLVTVSS (SEQ ID NO: 8013) |
| TRCBC2 binder BKM240 VL-2-SEQ ID NO: 8014 | TRBC2-binding, Light Chain | DVVMTQSPLSLPVTLGQPASISCRSSKNLVHSNGRTYLQWYQQRPGQSPRLLIYRVSNRFPGVPDRFSGSGSGTDFTLKISRVEAEDVGVYFCSQSTREPYTFGGGTKVEIK (SEQ ID NO: 8014) |
| TRCBC2 binder BKM0311 VH-3-SEQ ID NO: 8020 | TRBC2-binding, Heavy Chain | QVQLVQSGAEVKKPGSSVKVSCKASPRGFYGYHMHWVRQAPGQGLEWMGFINPYNNHIQYNERFRGRVTITSDESTTTAYMELSSLRSEDTAVYYCALGEGKWGDGAYRFFDFWGQGTLVTVSS(SEQ ID NO: 8020) |
| TRCBC2 binder BKM0311 VL-3-SEQ ID NO: 8021 | TRBC2-binding, Light Chain | DVVMTQSPLSLPVTLGQPASISCRSSKNLVHSNGRTYLQWYQQRPGQSPRLLIYRVSNREPGVPDRFSGSGSGTDFTLKISRVEAEDVGVYFCSQSTREPYTFGGGTKVEIK(SEQ ID NO: 8021) |
| TRCBC2 binder BKM0312 VH-4-SEQ ID NO: 8022 | TRBC2-binding, Heavy Chain | QVQLVQSGAEVKKPGSSVKVSCKASPRGFYGYHMHWVRQAPGQGLEWMGFINPYNNHIQYNERFRGRVTITSDESTTTAYMELSSLRSEDTAVYYCALGAGKWGDGAYRFFDFWGQGTLVTVSS (SEQ ID NO: 8022) |
| TRCBC2 binder BKM0312 VL-4-SEQ ID NO: 8023 | TRBC2-binding, Light Chain | DVVMTQSPLSLPVTLGQPASISCRSSKNLVHSNGRTYLQWYQQRPGQSPRLLIYRVSNRFPGVPDRFSGSGSGTDFTLKISRVEAEDVGVYFCSQSTREPYTFGGGTKVEIK (SEQ ID NO: 8023) |

TABLE 14

| Heavy Chain (HC) and Light Chain (LC) CDR sequences of TCBC2 from domains listed in Table 13. | | |
|---|---|---|
| HC CDR1 | HC CDR2 | HC CDR3 |
| PRGFYGYHMH (SEQ ID NO: 8272) per ABM numbering system/or, {GYHMH, SEQ ID NO: 7401 per Kabat numbering system} | FINPYTNDIQYNERFRG (SEQ ID NO: 8260) | GNGKWGDGAYRFFDL (SEQ ID NO: 8043, 8227) |
| PRGFYGYHMH (SEQ ID NO: 8272) {GYHMH, SEQ ID NO: 7401 per Kabat numbering system} | FINPYNNHIQYNERFRG (SEQ ID NO: 8044) | GNGKWGDGAYRFFDF (SEQ ID NO: 8045) |
| PRGFYGYHMH (SEQ ID NO: 8272) {GYHMH, SEQ ID NO: 7401 per Kabat numbering system} | FINPYNNHIQYNERFRG (SEQ ID NO: 8044) | GEGKWGDGAYRFFDF (SEQ ID NO: 8046) |
| PRGFYGYHMH (SEQ ID NO: 8272) {or, GYHMH, SEQ ID NO: 7401 per Kabat numbering system} | FINPYNNHIQYNERFRG (SEQ ID NO: 8044) | GAGKWGDGAYRFFDF (SEQ ID NO: 8047) |
| LC CDR1 | LC CDR2 | LC CDR3 |
| RSSENLVHSNGRTYLQ (SEQ ID NO: 8048) | RVSNRFP (SEQ ID NO: 8049) | SQSSLEPYT (SEQ ID NO: 8050) |
| RSSKNLVHSNGRTYLQ (SEQ ID NO: 8051) | RVSNRFP (SEQ ID NO: 8049) | SQSTREPYT (SEQ ID NO: 8052) |

Additional TRBC2 binding variable heavy chain (VH) and variable light chain (VL) sequences that are used for generating anti-TRBC2 scFv are listed in Table 15:

TABLE 15

TRBC2 binding heavy chain and light chain pairs for scFv. In each sequence the CDR1 is marked in bold font underlined (according to combined Kabat and Chothia [ABM] numbering system), the CDR2 is marked in italicized font (Kabat numbering system), and the CDR3 (Kabat numbering system) is marked in bold and italicized font that is underlined.

| Name | Sequence |
|---|---|
| L1L2P3-A10 VH | QVQLVQSGAEVKKPGASVKVSCKAS**RSGFHGYAMH**WVRQAPGQGLEWMG*FINPYNDDIQYNQKFQG*RVTITADESTSTAYMELSSLRSEDTAVYYCAR***GNGKWGDGAYRFFDF***WGQGTLVTVSS (SEQ ID NO: 8059) |
| L1L2P3-A10 VL | DVVMTQSPLSLPVTPGEPASISC**RSSQNLVHSNGRTYLQ**WYLQKPGQSPQLLIY*RVSNRFP*GVPDRFSGSGSGTDFTLKISRVEAEDVGVYFC***SQSTHVPYT***FGGGTKVEIK (SEQ ID NO: 8060) |
| L1L2P3-A12 VH | QVQLVQSGAEVKKPGSSVKVSCKAS**PRGFYGYHMHW**VRQAPGQGLEWMG*YINPYNRDIKYNQKFQG*RVTITADKSTTTAYMELSSLRSEDTAVYYCAR***GNGKWGDGAYRFFDF***WGQGTLVTVSS (SEQ ID NO: 8061) |
| L1L2P3-A12 VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8062) |
| L1L2P3-A2 VH | QVQLVQSGAEVKKPGSSVKVSCKAS**PRGFHGYHMH**WVRQAPGQGLEWMG*YINPYTGDIKYNERFRG*RVTITSDESTTTAYMELSSLRSEDTAVYYCA***RGNGKWGDGAYRFFDL***WGQGTLVTVSS (SEQ ID NO: 8063) |
| L1L2P3-A2 VL | DVVMTQSPLSLPVTLGQPASISC**RSSENLVHSNGRTYLQ**WYQQRPGQSPRLLIY*RVSNRF*PGVPDRFSGSGSGTDFTLKISRVEAEDVGVYFC***SQSTLEPFT***FGGGTKVEIK (SEQ ID NO: 8064) |
| L1L2P3-A5 VH | QVQLVQSGAEVKKPGSSVKVSCKAS**PRGFYGYHMH**WVRQAPGQGLEWMG*FINPYNDDIQYNERFRG*RVTITSDESTTTAYMELSSLRSEDTAVYYCA***LGNGKWGDGAYRFFDL***WGQGTLVTVSS (SEQ ID NO: 8065) |
| L1L2P3-A5 VL | DVVMTQSPLSLPVTLGQPASISC**RSSQNLVHSNGRTYLQ**WYQQRPGQSPRLLIY*RVSNRF*PGVPDRFSGSGSGTDFTLKISRVEAEDVGVYFC***SQSSLLPYT***FGGGTKVEIK (SEQ ID NO: 8066) |
| L1L2P3-A7 VH | QVQLVQSGAEVKKPGSSVKVSCKAS**PRGFYGYHMH**WVRQAPGQGLEWMG*FINPYNDDIQYNQKFQG*RVTITADKSTTTAYMELSSLRSEDTAVYYCA**R*GNGKWGDGAYRFFDF***WGQGTLVTVSS (SEQ ID NO: 8067) |
| L1L2P3-A7 VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFCSQ***STHVPYT***FGGGTKVEIK (SEQ ID NO: 8068) |
| L1L2P3-A5 VH | QVQLVQSGAEVKKPGSSVKVSCKAS**PRGFYGYHMH**WVRQAPGQGLEWMG*FINPYNDDIQYNERFRG*RVTITSDESTTTAYMELSSLRSEDTAVYYCA***LGNGKWGDGAYRFFDL***WGQGTLVTVSS (SEQ ID NO: 8069) |
| L1L2P3-A5 VL | DVVMTQSPLSLPVTLGQPASISC**RSSQNLVHSNGRTYLQ**WYQQRPGQSPRLLIY*RVSNRF*PGVPDRFSGSGSGTDFTLKISRVEAEDVGVYFC***SQSSLLPYTF***GGGTKVEIK (SEQ ID NO: 8070) |
| L1L2P3-A7 VH | QVQLVQSGAEVKKPGSSVKVSCKAS**PRGFYGYHMH**WVRQAPGQGLEWMG*FINPYNDDIQYNQKFQG*RVTITADKSTTTAYMELSSLRSEDTAVYYCAR***GNGKWGDGAYRFFDF***WGQGTLVTVSS (SEQ ID NO: 8071) |
| L1L2P3-A7 VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8072) |
| L1L2P3-A9 VH | QVQLVQSGAEVKKPGASVKVSCKA**SRSGFHGYAMH**WVRQAPGQGLEWMG*FINPYNDDIQYNQKFQG*RVTITADESTSTAYMELSSLRSEDTAVYYCA***RGNGKWGDGAYRFFDL***WGQGTLVTVSS (SEQ ID NO: 8073) |
| L1L2P3-A9 VL | DVVMTQSPLSLPVTLGQPASISC**RSSQNLVHSNARTYLQ**WYQQRPGQSPRLLIY*RVSNRF*PGVPDRFSGSGSGTDFTLKISRVEAEDVGVYFC***SQSTHVPYT***FGGGTKVEIK (SEQ ID NO: 8074) |
| L1L2P3-B1 VH | QVQLVQSGAEVKKPGSSVKVSCKAS**PRGFHGYHMH**WVRQAPGQGLEWMG*SINPYTRHIQYNERFRG*RVTITSDESTTTAYMELSSLRSEDTAVYYCAR***GNGKWGDGAYRFF***DEWGQGTLVTVSS (SEQ ID NO: 8075) |

TABLE 15-continued

TRBC2 binding heavy chain and light chain pairs for scFv. In each sequence the CDR1 is marked in bold font underlined (according to combined Kabat and Chothia [ABM] numbering system), the CDR2 is marked in italicized font (Kabat numbering system), and the CDR3 (Kabat numbering system) is marked in bold and italicized font that is underlined.

| Name | Sequence |
|---|---|
| L1L2P3-B1 VL | DVVMTQSPLSLPVTLGQPASISC**RSSQNLVHSNGRTYLQ**WYQQRPGQSPRLLIY*RVSNRF*PGVPDRFSGSGSGTDFTLKISRVEAEDVGVYFC***SQSSYVPFT***FGGGTKVEIK (SEQ ID NO: 8076) |
| L1L2P3-B11 VH | QVQLVQSGAEVKKPGSSVKVSCKAS**PRGFYGYHMH**WVRQAPGQGLEWMG*TINPYNRDIQYNQKFQG*RVTITADKSTSTAYMELSSLRSEDTAVYYCA***RGNGKWGDGAYRFFDL***WGQGTLVTVSS (SEQ ID NO: 8077) |
| L1L2P3-B11 VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8078) |
| L1L2P3-B12 VH | QVQLVQSGAEVKKPGSSVKVSCKAS**PRGFYGYHMH**WVRQAPGQGLEWMG*TINPYNRDIQYNQKFQG*RVTITADKSTSTAYMELSSLRSEDTAVYYCA***RGNGKWGDGAYRFFDF***WGQGTLVTVSS (SEQ ID NO: 8079) |
| L1L2P3-B12VL | DVVMTQSPLSLPVTPGEPASISC**RSSQNLVHSNGRTYLH**WYLQKPGQSPQLLIY*RVSNRF*PGVPDRFSGSGSGTDFTLKISRVEAEDVGVYFC***SQSTHVPYT***FGGGTKVEIK (SEQ ID NO: 8080) |
| L1L2P3-B2 | QVQLVQSGAEVKKPGSSVKVSCKAS**PRGFYGYHMH**WVRQAPGQGLEWMGYINPYTNEIKYNERFRGRVTITSDESTTTAYMELSSLRSEDTAVYYCA***RGNGKWGDGAYRFFDL***WGQGTLVTVSS (SEQ ID NO: 8081) |
| VL | DVVMTQSPLSLPVTLGQPASISC**RSSKNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8670, 8081) |
| L1L2P3-B3 VH | QVQLVQSGAEVKKPGSSVKVSCKAS**PRGFYGYHMH**WVRQAPGQGLEWMG*FINPYNDDIQYNQKFQG*RVTITADESTSTAYMELSSLRSEDTAVYYCAR***GNGKWGDGAYRFFDF***WGQGTLVTVSS (SEQ ID NO: 8082) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC*SQSTHVPYT*FGGGTKVEIK (SEQ ID NO: 8083) |
| L1L2P3-B4 VH | QVQLVQSGAEVKKPGSSVKVSCKAS**PRGFYGYHMH**WVRQAPGQGLEWMG*TINPYNAEIKYNQKFQG*RVTITADKSTSTAYMELSSLRSEDTAVYYCAR***GNGKWGDGAYRFFDF***WGQGTLVTVSS (SEQ ID NO: 8084) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYYC*SQSTYEPFT*FGGGTKVEIK (SEQ ID NO: 8085) |
| L1L2P3-B5 VH | QVQLVQSGAEVKKPGSSVKVSCKAS**PRGFYGYHMH**WVRQAPGQGLEWMG*FINPYNRDIKYNERFRG*RVTITSDKSTTTAYMELSSLRSEDTAVYYCA***MGNGKWGDGAYRFFDL***WGQGTLVTVSS (SEQ ID NO: 8086) |
| VL | DVVMTQSPLSLPVTLGQPASISC**RSSKNLVHSNGRTYLQ**WYQQRPGQSPRLLIY*RVSNRF*PGVPDRFSGSGSGTDFTLKISRVEAEDVGVYFC***SQSSHIPYT***FGGGTKVEIK (SEQ ID NO: 8087) |
| L1L2P3-B7 VH | QVQLVQSGAEVKKPGSSVKVSCKAS**PRGFYGYHMH**WVRQAPGQGLEWMG*AINPYTNDIKYNERFRG*RVTITSDKSTTTAYMELSSLRSEDTAVYYCAR***GNGKWGDGAYRFFDL***WGQGTLVTVSS (SEQ ID NO: 8088) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8089) |
| L1L2P3-B8 VH | QVQLVHSGAEVKKPGSSVKVSCKAS**PRGFYGYHMH**WVRQAPGQGLEWMG*TINPYNRHIKYNQKFQ*GRVTITADKSTTTAYMELSSLRSEDTAVYYCAR***GNGKWGDGAYRFFDF***WGQGTLVTVSS (SEQ ID NO: 8090) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8091) |

TABLE 15-continued

TRBC2 binding heavy chain and light chain pairs for scFv. In each sequence the CDR1 is marked in bold font underlined (according to combined Kabat and Chothia [ABM] numbering system), the CDR2 is marked in italicized font (Kabat numbering system), and the CDR3 (Kabat numbering system) is marked in bold and italicized font that is underlined.

| Name | Sequence |
|---|---|
| L1L2P3-C1 VH | QVQLVQSGAEVKKPGASVKVSCKASPRGFHGYHMHWVRQAPGQGLEWMGSINPYTDDIQYNERFRGRVTITSDESTTTAYMELSSLRSEDTAVYYCARGNGKWGDGAYRFFDFWGQGTLVTVSS (SEQ ID NO: 8092) |
| VL | DVVMTQSPLSLPVTLGQPASISCRSSENLVHSNGRTYLQWYQQRPGQSPRLLIYRVSNRFPGVPDRFSGSGSGTDFTLKISRVEAEDVGVYFCSQSTHVPYTFGGGTKVEIK (SEQ ID NO: 8093) |
| L1L2P3-C10 VH | QVQLVQSGAEVKKPGSSVKVSCKASPRGFYGYHMHWVRQAPGQGLEWMGAINPYTNHIQYNERFRGRVTITSDESTTTAYMELSSLRSEDTAVYYCARGNGKWGDGAYRFFDLWGQGTLVTVSS (SEQ ID NO: 8094) |
| VL | DVVMTQSPLSLPVTLGQPASISCRSSQNLVHSNGRTYLQWYQQRPGQSPRLLIYRVSNRFPGVPDRFSGSGSGTDFTLKISRVEAEDVGVYFCSQSTHVPYTFGGGTKVEIK (SEQ ID NO: 8095) |
| L1L2P3-C4 VH | QVQLVQSGAEVKKPGSSVKVSCKASPRGFYGYHMHWVRQAPGQGLEWMGFINPYNDDIQYNQKFQGRVTITADKSTSTAYMELSSLRSEDTAVYYCARGNGKWGDGAYRFFDFWGQGTLVTVSS (SEQ ID NO: 8096) |
| | DVVMTQSPLSLPVTLGQPASISCRSSQNLVHSNARTYLQWYQQRPGQSPRLLIYRVSNRFPGVPDRFSGSGSGTDFTLKISRVEAEDVGVYYCSQSTYIPYTFGGGTKVEIK (SEQ ID NO: 8097) |
| L1L2P3-C5 VH | QVQLVQSGAEVKKPGSSVKVSCKASPRGFHGYHMHWVRQAPGQGLEWMGFINPYTRAIKYNERFRGRVTITSDKSTTTAYMELSSLRSEDTAVYYCARGNGKWGDGAYRFFDLWGQGTLVTVSS (SEQ ID NO: 8098) |
| VL | DVVMTQSPLSLPVTLGQPASISCRSSQNLVHSNGRTYLQWYLQKPGQSPQLLIYRVSNRFPGVPDRFSGSGSGTDFTLKISRVEAEDVGVYFCSQSTHVPYTFGGGTKVEIK (SEQ ID NO: 8099) |
| L1L2P3-C7 VH | QVQLVQSGAEVKKPGSSVKVSCKASPRGFYGYHMHWVRQAPGQGLEWMGAINPYTRAIKYNERFRGRVTITSDESTTTAYMELSSLRSEDTAVYYCARGNGKWGDGAYRFFDLWGQGTLVTVSS (SEQ ID NO: 8100) |
| VL | DVVMTQSPLSLPVTLGQPASISCRSSQNLVHSNGRTYLQWYQQRPGQSPRLLIYRVSNRFPGVPDRFSGSGSGTDFTLKISRVEAEDVGVYFCSQSTYEPYTFGGGTKVEIK (SEQ ID NO: 8101) |
| L1L2P3-C9 VH | QVQLVQSGAEVKKPGSSVKVSCKASPRGFYGYHMHWVRQAPGQGLEWMGTINPYNGDIQYNERFRGRVTMTSDKSTTTAYMELSSLRSEDTAVYYCARGNGKWGDGAYRFFDFWGQGTLVTVSS (SEQ ID NO: 8102) |
| VL | DVVMTQSPLSLPVTPGEPASISCRSSQNLVHSNGRTYLQWYLQKPGQSPQLLIYRVSNRFPGVPDRFSGSGSGTDFTLKISRVEAEDVGVYFCSQSTHVPYTFGGGTKVEIK (SEQ ID NO: 8103) |
| L1L2P3-D10 VH | QVQLVQSGAEVKKPGSSVKVSCKASPRGFYGYHMHWVRQAPGQGLEWMGAINPYNTDIKYNERFRGRVTITSDESTTTAYMELSSLRSEDTAVYYCARGNGKWGDGAYRFFDLWGQGTLVTVSS (SEQ ID NO: 8104) |
| VL | DVVMTQSPLSLPVTLGQPASISCRSSQNLVHSNGRTYLQWYQQRPGQSPRLLIYRVSNRFPGVPDRFSGSGSGTDFTLKISRVEAEDVGVYFCSQSTHVPYTFGGGTKVEIK (SEQ ID NO: 8105) |
| L1L2P3-D12 VH | QVQLVQSGAEVKKPGSSVKVSCKASPRGFYGYHMHWVRQAPGQGLEWMGYINPYNGAIKYNQKFQGRVTITADESTSTAYMELSSLRSEDTAVYYCARGNGKWGDGAYRFFDLWGQGTLVTVSS (SEQ ID NO: 8106) |
| VL | DVVMTQSPLSLPVTLGQPASISCRSSQNLVHSNGRTYLQWYLQKPGQSPQLLIYRVSNRFPGVPDRFSGSGSGTDFTLKISRVEAEDVGVYFCSQSTHVPYTFGGGTKVEIK (SEQ ID NO: 8107) |
| L1L2P3-E10 VH | QVQLVQSGAEVKKPGSSVKVSCKASPRGFYGYHMHWVRQAPGQGLEWMGAINPYNDDIQSNERFRGRVTITSDKSTTTAYMELSSLRSEDTAVYYCARGNGKWGDGAYRFFDLWGQGTLVTVSS (SEQ ID NO: 8108) |

TABLE 15-continued

TRBC2 binding heavy chain and light chain pairs for scFv. In each sequence the CDR1 is marked in bold font underlined (according to combined Kabat and Chothia [ABM] numbering system), the CDR2 is marked in italicized font (Kabat numbering system), and the CDR3 (Kabat numbering system) is marked in bold and italicized font that is underlined.

| Name | Sequence |
|---|---|
| VL | DVVMTQSPLSLPVTLGQPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8109) |
| L1L2P3-E12 VH | QVQLVQSGAEVKKPGSSVKVSCKAS**PRGFYGYHMH**WVRQAPGQGLEWMG*FINPYNRAIQYNQKFQ*GRVTITADKSTTTAYMELSSLRSEDTAVYYCAR***GNGKWGDGAYRFFDF***WGQGTLVTVSS (SEQ ID NO: 8110) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8112) |
| L1L2P3-E6 VH | QVQLVQSGAEVKKPGASVKVSCKAS**PRGFHGYHMH**WVRQAPGQGLEWMG*FINPYTNEJQYNERFRG*RVTITSDESTTTAYMELSSLRSEDTAVYYCAR***GNGKWGDGAYRFFDL***WGQGTLVTVSS (SEQ ID NO: 8113) |
| VL | DVVMTQSPLSLPVTLGQPASISC**RSSQNLVHSNGRTYLQ**WYQQRPGQSPRLLIY*RVSNRF*PGVPDRFSGSGSGTDFTLKISRVEAEDVGVYFC***SQSTHVPYT***FGGGTKVEIK (SEQ ID NO: 8114) |
| L1L2P3-E9 VH | QVQLVQSGAEVKKPGSSVKVSCKAS**PRGFYGYHMH**WVRQAPGQGLEWMG*YINPYNHDIQYNQKFQG*RVTITADKSTSTAYMELSSLRSEDTAVYYCAR***GNGKWGDGAYRFFDF***WGQGTLVTVSS (SEQ ID NO: 8115) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8116) |
| L1L2P3-FlaTRBC2e31 VH | QVQLVQSGAEVKKPGSSVKVSCKAS**PRGFYGYHMH**WVRQAPGQGLEWMG*SINPYTHDIQYNERFRG*RVTITSDESTTTAYMELSSLRSEDTAVYYCA***RGNGKWGDGAYRFFDL***WGQGTLVTVSS (SEQ ID NO: 8117) |
| VL | DVVMTQSPLSLPVTLGQPASISC***RSSQNLVHSNGRTYLQ***WYLQKPGQSPQLLIY*RVSNRF*PGVPDRFSGSGSGTDFTLKISRVEAEDVGVYFC***SQSTHVPYT***FGGGTKVEIK (SEQ ID NO: 8118) |
| L1L2P3-F11 VH | QVQLVQSGAEVKKPGSSVKVSCKAS**PRGFYGYHMH**WVRQAPGQGLEWMG*YINPYKNAIQYNQKFQG*RVTITADKSTTTAYMELSSLRSEDTAVYYCAR***GNGKWGDGAYRFFDF***WGQGTLVTVSS (SEQ ID NO: 8119) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8120) |
| L1L2P3-F2 VH | QVQLVQSGAEVKKPGSSVKVSCKAS**PRGFYGYHMH**WVRQAPGQGLEWMG*AINPYNTDIQYNERFRG*RVTITSDKSTTTAYMELSSLRSEDTAVYYCAR***GNGKWGDGAYRFFDF***WGQGTLVTVSS (SEQ ID NO: 8121) |
| VL | DVVMTQSPLSLPVTLGQPASISCRSSENLVHSNGRTYLQWYQQRPGQSPRLLIY*RVSNRF*PGVPDRFSGSGSGTDFTLKISRVEAEDVGVYFC***SQSSHIPYT***FGGGTKVEIK (SEQ ID NO: 8122) |
| L1L2P3-F6 VH | QVQLVQSGAEVKKPGSSVKVSCKAS**PRGFYGYHMH**WVRQAPGQGLEWMG*SINPYNGDIQYNERFRG*RVTITSDKSTTTAYMELSSLRSEDTAVYYCAR***GNGKWGDGAYRFFDF***WGQGTLVTVSS (SEQ ID NO: 8123) |
| VL | DVVMTQSPLSLPVTLGQPASISC**RSSQNLVHSNGRTYLQ**WYQQRPGQSPRLLIY*RVSNRF*PGVPDRFSGSGSGTDFTLKISRVEAEDVGVYFC***SQSTHLPYT***FGGGTKVEIK (SEQ ID NO: 8124) |
| L1L2P3-G10 VH | QVQLVQSGAEVKKPGSSVKVSCKAS**PRGFYGYHMH**WVRQAPGQGLEWMG*TINPYNHDAQYNERFRG*RVTITSDKSTTTAYMELSSLRSEDTAVYYCAR***GNGKWGDGAYRFFDF***WGQGTLVTVSS (SEQ ID NO: 8125) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8126) |
| L1L2P3-G11 VH | QVQLVQSGAEVKKPGSSVKVSCKAS**PRGFYGYHMH**WVRQAPGQGLEWMG*FINPYNHAIKYNQKFQG*RVTITADKSTSTAYMELSSLRSEDTAVYYCAR***GNGKWGDGAYRFFDF***WGQGTLVTVSS (SEQ ID NO: 8127) |

TABLE 15-continued

TRBC2 binding heavy chain and light chain pairs for scFv. In each sequence the CDR1 is marked in bold font underlined (according to combined Kabat and Chothia [ABM] numbering system), the CDR2 is marked in italicized font (Kabat numbering system), and the CDR3 (Kabat numbering system) is marked in bold and italicized font that is underlined.

| Name | Sequence |
|---|---|
| VL | DVVMTQSPLSLPVTPGEPASISCRSSQNLVHSNGRTYLHWYLQKPGQSPQLLIYRVSNRFPGVPDRFSGSGSGTDFTLKISRVEAEDVGVYFCSQSTHVPYTFGGGTKVEIK (SEQ ID NO: 8128) |
| L1L2P3-G3 VH | QVQLVQSGAEVKKPGSSVKVSCKASPRGFYGYHMHWVRQAPGQGLEWMGYINPYNNAIQYNQKFQGRVTMTSDKSTTTAYMELSSLRSEDTAVYYCARGNGKWGDGAYRFFDFWGQGTLVTVSS (SEQ ID NO: 8129) |
| | DVVMTQSPLSLPVTLGQPASISCRSSQNLVHSNGRTYLQWYLQKPGQSPQLLIYRVSNRFPGVPDRFSGSGSGTDFTLKISRVEAEDVGVYFCSQSTHVPYTFGGGTKVEIK (SEQ ID NO: 8130) |
| L1L2P3-G6 VH | QVQLVQSGAEVKKPGSSVKVSCKASPRGFYGYHMHWVRQAPGQGLEWMGFINPYTNDIQYNERFRGRVTITSDKSTTTAYMELSSLRSEDTAVYYCAMGNGKWGDGAYRFFDLWGQGTLVTVSS (SEQ ID NO: 8131) |
| VL | DVVMTQSPLSLPVTLGQPASISCRSSQNLVHSNGRTYLQWYQQRPGQSPRLLIYRVSNRFPGVPDRFSGSGSGTDFTLKISRVEAEDVGVYFCSQSTHVPYTFGGGTKVEIK (SEQ ID NO: 8132) |
| L1L2P3-G9 VH | QVQLVQSGAEVKKPGSSVKVSCKASPRGFYGYHMHWVRQAPGQGLEWMGAINPYTNEIKYNERFRGRVTITSDESTTTAYMELSSLRSEDTAVYYCARGNGKWGDGAYRFFDFWGQGTLVTVSS (SEQ ID NO: 8133) |
| VL | DVVMTQSPLSLPVTLGQPASISCRSSQNLVHSNGRTYLQWYQQRPGQSPRLLIYRVSNRFPGVPDRFSGSGSGTDFTLKISRVEAEDVGVYFCSQSTHLPYTFGGGTKVEIK (SEQ ID NO: 8134) |
| L1L2P3-H11 VH | QVQLVQSGAEVKKPGSSVKVSCKASPRGFYGYHMHWVRQAPGQGLEWMGFINPYNDDIQYNQKFQGRVTITADKSTSTAYMELSSLRSEDTAVYYCARGNGKWGDGAYRFFDFWGQGTLVTVSS (SEQ ID NO: 8135) |
| VL | DVVMTQSPLSLPVTPGEPASISCRSSQNLVHSNGRTYLQWYLQKPGQSPQLLIYRVSNRFPGVPDRFSGSGSGTDFTLKISRVEAEDVGVYFCSQSTHVPYTFGGGTKVEIK (SEQ ID NO: 8136) |
| L1L2P3-H2 VH | QVQLVQSGAEVKKPGSSVKVSCKASPRGFYGYHMHWVRQAPGQGLEWMGAINPYNDDIQYNERFRGRVTITSDESTTTAYMELSSLRSEDTAVYYCALGNGKWGDGAYRFFDFWGQGTLVTVSS (SEQ ID NO: 8137) |
| VL | DVVMTQSPLSLPVTPGEPASISCRSSQNLVHSNGRTYLQWYLQKPGQSPQLLIYRVSNRFPGVPDRFSGSGSGTDFTLKISRVEAEDVGVYFCSQSTHVPYTFGGGTKVEIK (SEQ ID NO: 8138) |
| L1L2P3-H3 VH | QVQLVQSGAEVKKPGASVKVSCKASPRGFHGYHMHWVRQAPGQGLEWMGYINPYNNDIKYNQKFQGRVTITADESTSTAYMELSSLRSEDTAVYYCARGNGKWGDGAYRFFDFWGQGTLVTVSS (SEQ ID NO: 8139) |
| VL | DVVMTQSPLSLPVTLGQPASISCRSSQNLVHSNGRTYLQWYLQKPGQSPQLLIYRVSNRFPGVPDRFSGSGSGTDFTLKISRVEAEDVGVYFCSQSTHVPYTFGGGTKVEIK (SEQ ID NO: 8140) |
| L1L2P3-H7 VH | QVQLVQSGAEVKKPGSSVKVSCKASPRGFHGYHMHWVRQAPGQGLEWMGFINPYTNDJQYNERFRGRVTITSDESTTTAYMELSSLRSEDTAVYYCALGNGKWGDGAYRFFDLWGQGTLVTVSS (SEQ ID NO: 8141) |
| VL | DVVMTQSPLSLPVTLGQPASISCRSSQNLVHSNGRTYLQWYLQKPGQSPQLLIYRVSNRFPGVPDRFSGSGSGTDFTLKISRVEAEDVGVYFCSQSTHVPYTFGGGTKVEIK (SEQ ID NO: 8142) |
| L1L2P3-H9 VH | QVQLVQSGAEVKKPGSSVKVSCKASPRGFYGYHMHWVRQAPGQGLEWMGTINPYKHHIKYNERFRGRVTITSDESTTTAYMELSSLRSEDTAVYYCARGNGKWGDGAYRFFDLWGQGTLVTVSS (SEQ ID NO: 8143) |
| VL | DVVMTQSPLSLPVTLGQPASISCRSSENLVHSNGRTYLQWYQQRPGQSPRLLIYRVSNRFPGVPDRFSGSGSGTDFTLKISRVEAEDVGVYFCSQSTQEPYTFGGGTKVEIK (SEQ ID NO: 8144) |

TABLE 15-continued

TRBC2 binding heavy chain and light chain pairs for scFv. In each sequence the CDR1 is marked in bold font underlined (according to combined Kabat and Chothia [ABM] numbering system), the CDR2 is marked in italicized font (Kabat numbering system), and the CDR3 (Kabat numbering system) is marked in bold and italicized font that is underlined.

| Name | Sequence |
|---|---|
| L1P1-A2 VH | QVQLVQSGAEVKKPGSSVKVSCKAS**PRGFYGYHMH**WVRQAPGQGLEWMG*TINPYNGDIQYNERFRG*RVTITSDESTTTAYMELSSLRSEDTAVYYCAR***GNGKWGDGAYRFFDF***WGQGTLVTVSS (SEQ ID NO: 8145) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC*SQSTHVPYT*FGGGTKVEIK (SEQ ID NO: 8146) |
| L1P1-A3 VH | QVQLVQSGAEVKKPGSSVKVSCKAS**PRGFYGYHMH**WVRQAPGQGLEWMG*AINPYNDDIKYNERFRG*RVTITSDKSTTTAYMELSSLRSEDTAVYYCAL***GNGKWGDGAYRFFDF***WGQGTLVTVSS (SEQ ID NO: 8147) |
| VL | DVVMTQSPLSLPVTLGQPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8148) |
| L1P1-A4 VH | QVQLVQSGAEVKKPGSSVKVSCKAS**PRGFYGYHMH**WVRQAPGQGLEWMG*YINPYTHEIKYNERFRG*RVTITSDESTTTAYMELSSLRSEDTAVYYCAR***GNGKWGDGAYRFFDF***WGQGTLVTVSS (SEQ ID NO: 8149) |
| VL | DVVMTQSPLSLPVTLGQPASISC**RSSKNLVHSNARTYLQ**WYQQRPGQSPRLLIY*RVSNRF*PGVPDRFSGSGSGTDFTLKISRVEAEDVGVYFC***SQSTHVPYT***FGGGTKVEIK (SEQ ID NO: 8150) |
| L1P1-A5 VH | QVQLVQSGAEVKKPGSSVKVSCKAS**PRGFYGYHMH**WVRQAPGQGLEWMG*FINPYKDDIKYNERFRG*RVTITSDKSTTTAYMELSSLRSEDTAVYYCAL***GNGKWGDGAYRFFDF***WGQGTLVTVSS (SEQ ID NO: 8151) |
| VL | DVVMTQSPLSLPVTLGQPASISC**RSSKNLVHSNGRTYLQ**WYQQRPGQSPRLLIY*RVSNRF*PGVPDRFSGSGSGTDFTLKISRVEAEDVGVYFC***SQSSLVPYT***FGGGTKVEIK (SEQ ID NO: 8152) |
| L1P1-A6 VH | QVQLVQSGAEVKKPGSSVKVSCKAS**PRGFYGYHMH**WVRQAPGQGLEWMG*AINPYNDDIQSNERFRG*RVTITSDKSTTTAYMELSSLRSEDTAVYYCAR***GNGKWGDGAYRFFDF***WGQGTLVTVSS (SEQ ID NO: 8153) |
| VL | DVVMTQSPLSLPVTPGEPASISC**RSSQNLVHSNGRTYLH**WYLQKPGQSPQLLIY*RVSNRF*PGVPDRFSGSGSGTDFTLKISRVEAEDVGVYFC***SQSTHVPYT***FGGGTKVEIK (SEQ ID NO: 8154) |
| L1P1-A8 VH | QVQLVQSGAEVKKPGSSVKVSCKAS**PRGFYGYHMH**WVRQAPGQGLEWMG*AINPYNDDIKYNQKFQG*RVTITADESTTTAYMELSSLRSEDTAVYYCAR***GNGKWGDGAYRFFDF***WGQGTLVTVSS (SEQ ID NO: 8155) |
| VL | DVVMTQSPLSLPVTPGEPASISC**RSSQNLVHSNGRTYLH**WYLQKPGQSPQLLIY*RVSNRF*PGVPDRFSGSGSGTDFTLKISRVEAEDVGVYFC***SQSTHVPYT***FGGGTKVEIK (SEQ ID NO: 8156) |
| L1P1-B1 VH | QVQLVQSGAEVKKPGSSLKVSCKASPRGFHGYHMHWVRQAPGQGLEWMG*AINPYNRDIKYNERFRG*RVTITSDESTTTAYMELSSLRSEDTAVYYCAR***GNGKWGDGAYRFFDL***WGQGTLVTVSS (SEQ ID NO: 8157) |
| VL | DVVMTQSPLSLPVTLGQPASISC**RSSKNLVHSNGRTYLQ**WYQQRPGQSPRLLIY*RVSNRF*PGVPDRFSGSGSGTDFTLKISRVEAEDVGVYFC***SQSTHVPYT***FGGGTKVEIK (SEQ ID NO: 8158) |
| L1P1-B6 VH | QVQLVQSGAEVKKPGSSVKVSCKAS**PRGFYGYHMH**WVRQAPGQGLEWMG*AINPYNGDIKYNERFRG*RVTITSDKSTTTAYMELSSLRSEDTAVYYCAR***GNGKWGDGAYRFFDF***WGQGTLVTVSS (SEQ ID NO: 8159) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8160) |
| L1P1-B8 VH | QVQLVQSGAEVKKPGSSVKVSCKAS**PRGFYGYHMH**WVRQAPGQGLEWMG*FINPYNNHIQYNERFRG*RVTITSDESTTTAYMELSSLRSEDTAVYYCAL***GNGKWGDGAYRFFDF***WGQGTLVTVSS (SEQ ID NO: 8161) |

TABLE 15-continued

TRBC2 binding heavy chain and light chain pairs for scFv. In each sequence the CDR1 is marked in bold font underlined (according to combined Kabat and Chothia [ABM] numbering system), the CDR2 is marked in italicized font (Kabat numbering system), and the CDR3 (Kabat numbering system) is marked in bold and italicized font that is underlined.

| Name | Sequence |
|---|---|
| VL | DVVMTQSPLSLPVTLGQPASISC**RSSKNLVHSNGRTYLQ**WYQQRPGQSPRLLIY*RVSNRF*PGVPDRFSGSGSGTDFTLKISRVEAEDVGVYFC***SQSTREPYT***FGGGTKVEIK (SEQ ID NO: 8162) |
| L1P1-D1 VH | QVQLVQSGAEVKKPGSSVKVSCKAS**PRGFYGYHMH**WVRQAPGQGLEWMG*YINPYTRDIKYNERFRG*RVTITSDESTTTAYMELSSLRSEDTAVYYCAR***GNGKWGDGAYRFFDF***WGQGTLVTVSS (SEQ ID NO: 8163) |
| VL | DVVMTQSPLSLPVTLGQPASISC**RSSQNLVHSNGRTYLQ**WYQQRPGQSPRLLIYRVSNREPGVPDRFSGSGSGTDFTLKISRVEAEDVGVYFCSQSTQMPYTFGGGTKVEIK (SEQ ID NO: 8164) |
| L1P1-D3 VH | QVQLVQSGAEVKKPGSSVKVSCKAS**PRGFYGYHMH**WVRQAPGQGLEWMG*TINPYNTDIKYNERFRG*RVTITSDKSTTTAYMELSSLRSEDTAVYYCAR***GNGKWGDGAYRFFDL***WGQGTLVTVSS (SEQ ID NO: 8165) |
| VL | DVVMTQSPLSLPVTLGQPASISC**RSSQNLVHSNARTYLQ**WYQQRPGQSPRLLIY*RVSNRF*PGVPDRFSGSGSGTDFTLKISRVEAEDVGVYFCSQSTYEPYTFGGGTKVEIK (SEQ ID NO: 8166) |
| L1P1-D6 VH | QVQLVQSGAEVKKPGSSVKVSCKAS**PRGFYGYHMH**WVRQAPGQGLEWMG*TINPYNNDIQYNERFRG*RVTITSDKSTTTAYMELSSLRSEDTAVYYCAR***GNGKWGDGAYRFFDF***WGQGTLVTVSS (SEQ ID NO: 8167) |
| VL | DVVMTQSPLSLPVTLGQPASISC**RSSQNLVHSNGRTYLH**WYLQKPGQSPQLLIY*RVSNRF*PGVPDRFSGSGSGTDFTLKISRVEAEDVGVYFC***SQSTHVPYT***FGGGTKVEIK (SEQ ID NO: 8168) |
| L1P1-E1 VH | QVQLVQSGAEVKKPGSSVKVSCKAS**PRGFYGYHMH**WVRQAPGQGLEWMG*YINPYNGNIQYNERFRG*RVTITSDESTTTAYMELSSLRSEDTAVYYCAR***GNGKWGDGAYRFFDF***WGQGTLVTVSS (SEQ ID NO: 8169) |
| VL | DVVMTQSPLSLPVTLGQPASISC**RSSKNLVHSNGRTYLQWYQ**QRPGQSPRLLIY*RVSNRF*PGVPDRFSGSGSGTDFTLKISRVEAEDVGVYFC***SQSSQEPYT***FGGGTKVEIK (SEQ ID NO: 8170) |
| L1P1-E2 VH | QVQLVQSGAEVKKPGSSVKVSCKAS**PRGFYGYHMH**WVRQAPGQGLEWMG*AINPYTNEIQYNERFRG*RVTITSDESTTTAYMELSSLRSEDTAVYYCAR***GNGKWGDGAYRFFDF***WGQGTLVTVSS (SEQ ID NO: 8171) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8172) |
| L1P1-E6 VH | QVQLVQSGAEVKKPGASVKVSCKAS**PRGFYGYHMH**WVRQAPGQGLEWMG*SINPYNHDIKYNERFRG*RVTITSDKSTTTAYMELSSLRSEDTAVYYCAR***GNGKWGDGAYRFFDF***WGQGTLVTVSS (SEQ ID NO: 8173) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8174) |
| L1P1-F1 VH | QVQLVQSGAEVKKPGSSVKVSCKAS**PRGFYGYHMH**WVRQAPGQGLEWMG*FINPYKNEIKYNERFRG*RVTITSDESTTTAYMELSSLRSEDTAVYYCAR***GNGKWGDGAYRFFDF***WGQGTLVTVSS (SEQ ID NO: 8175) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8176) |
| L1P1-F4 VH | QVQLVQSGAEVKKPGSSVKVSCKAS**PRGFYGYHMH**WVRQAPGQGLEWMG*YINPYNNEJQYNERFRG*RVTITSDESTTTAYMELSSLRSEDTAVYYCAR***GNGKWGDGAYRFFDF***WGQGTLVTVSS (SEQ ID NO: 8177) |
| VL | DVVMTQSPLSLPVTPGEPASISC**RSSQNLVHSNGRTYLH**WYLQKPGQSPQLLIY*RVSNRF*PGVPDRFSGSGSGTDFTLKISRVEAEDVGVYFC***SQSTHVPYT***FGGGTKVEIK (SEQ ID NO: 8178) |

TABLE 15-continued

TRBC2 binding heavy chain and light chain pairs for scFv. In each sequence the CDR1 is marked in bold font underlined (according to combined Kabat and Chothia [ABM] numbering system), the CDR2 is marked in italicized font (Kabat numbering system), and the CDR3 (Kabat numbering system) is marked in bold and italicized font that is underlined.

| Name | Sequence |
|---|---|
| L1P1-F6 VH | QVQLVQSGAEVKKPGSSVKVSCKAS**PRGFYGYHMH**WVRQAPGQGLEWMG*SINPYNRHIQYNERFRG*RVTITSDKSTTTAYMELSSLRSEDTAVYYCAR***GNGKWGDGAYRFFDF***WGQGTLVTVSS (SEQ ID NO: 8179) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8180) |
| L1P1-F7 VH | QVQLVQSGAEVKKPGSSVKVSCKAS**PRGFYGYHMH**WVRQAPGQGLEWMG*SINPYTREJQYNERFRG*RVTITSDKSTTTAYMELSSLRSEDTAVYYCAR***GNGKWGDGAYRFFDL***WGQGTLVTVSS (SEQ ID NO: 8181) |
| VL | DVVMTQSPLSLPVTLGQPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8182) |
| L1P1-F9 VH | QVQLVQSGAEVKKPGSSVKVSCKAS**PRGFYGYHMH**WVRQAPGQGLEWMG*FINPYTNDIQYNERFRG*RVTITSDESTTTAYMELSSLRSEDTAVYYCAM***GNGKWGDGAYRFFDL***WGQGTLVTVSS (SEQ ID NO: 8183) |
| VL | DVVMTQSPLSLPVTLGQPASISC**RSSENLVHSNGRTYLQ**WYQQRPGQSPRLLIY*RVSNRF*PGVPDRFSGSGSGTDFTLKISRVEAEDVGVYFC***SQSSLEPYT***FGGGTKVEIK (SEQ ID NO: 8184) |
| L1P1-G9 VH | QVQLVQSGAEVKKPGSSVKVSCKAS**PRGFYGYHMH**WVRQAPGQGLEWMGFINPYNDDIQSNERFQGRVTITADESTSTAYMELSSLRSEDTAVYYCAM***GNGKWGDGAYRFFDL***WGQGTLVTVSS (SEQ ID NO: 8185) |
| VL | DVVMTQSPLSLPVTLGQPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8186) |
| L1P1-H4 VH | QVQLVQSGAEVKKPGSSVKVSCKAS**PRGFYGYHMH**WVRQAPGQGLEWMGSINPYTHNIKYNERFRGRVTITSDESTTTAYMELSSLRSEDTAVYYCAR***GNGKWGDGAYRFFDF***WGQGTLVTVSS (SEQ ID NO: 8187) |
| VL | DVVMTQSPLSLPVTLGQPASISC**RSSQNLVHSNGRTYLQ**WYQQRPGQSPRLLIY*RVSNRF*PGVPDRFSGSGSGTDFTLKISRVEAEDVGVYFC***SQSTHVPYT***FGGGTKVEIK (SEQ ID NO: 8188) |
| L2P1-A7 VH | QVQLVQSGAEVKKPGSSVKVSCKAS**PRGFYGYHMH**WVRQAPGQGLEWMGYINPYNHEIKYNQKFQGRVTITADKSTTTAYMELSSLRSEDTAVYYCAR***GNGKWGDGAYRFFDF***WGQGTLVTVSS (SEQ ID NO: 8189) |
| VL | DVVMTQSPLSLPVTPGEPASISC**RSSQNLVHSNGRTYLH**WYLQKPGQSPQLLIY*RVSNRF*PGVPDRFSGSGSGTDFTLKISRVEAEDVGVYFC***SQSTHVPYT***FGGGTKVEIK (SEQ ID NO: 8190) |
| L2P1-B12 VH | QVQLVQSGAEVKKPGSSVKVSCKAS**PRGFYGYHMH**WVRQAPGQGLEWMGSINPYTRNIQYNQKFRGRVTMTSDKSTTTAYMELSSLRSEDTAVYYCAR***GNGKWGDGAYRFFDF***WGQGTLVTVSS (SEQ ID NO: 8191) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8192) |
| L2P1-D7 VH | QVQLVQSGAEVKKPGSSVKVSCKAS**PRGFYGYHMH**WVRQAPGQGLEWMGYINPYNGAIQYNQKFQGRVTITADESTSTAYMELSSLRSEDTAVYYCAR***GNGKWGDGAYRFFDL***WGQGTLVTVSS (SEQ ID NO: 8193) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8194) |
| L2P1-D8 VH | QVQLVQSGAEVKKPGSSVKVSCKAS**PRGFYGYHMH**WVRQAPGQGLEWMG*TINPYTREIQYNQKFQG*RVTITADKSTTTAYMELSSLRSEDTAVYYCAR***GNGKWGDGAYRFFDF***WGQGTLVTVSS (SEQ ID NO: 8195) |

TABLE 15-continued

TRBC2 binding heavy chain and light chain pairs for scFv. In each sequence the CDR1 is marked in bold font underlined (according to combined Kabat and Chothia [ABM] numbering system), the CDR2 is marked in italicized font (Kabat numbering system), and the CDR3 (Kabat numbering system) is marked in bold and italicized font that is underlined.

| Name | Sequence |
| --- | --- |
| VL | DVVMTQSPLSLPVTPGEPASISC**RSSQNLVHSNGRTYLH**WYLQKPGQSPQLLIY*RVSNRF*PGVPDRFSGSGSGTDFTLKISRVEAEDVGVYFC***SQSTHVPYT***FGGGTKVEIK (SEQ ID NO: 8196) |
| L2P1-E9 VH | QVQLVQSGAEVKKPGSSVKVSCKAS**PRGFYGYAMH**WVRQAPGQGLEWMG*YINPYNNEIQYNQKFQG*RVTITADKSTTTAYMELSSLRSEDTAVYYCAR***GNGKWGDGAYRFFDF***WGQGTLVTVSS (SEQ ID NO: 8197) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYTF***GGGTKVEIK (SEQ ID NO: 8198) |
| L2P1-F12 VH | QVQLVQSGAEVKKPGSSVKVSCKAS**PRGFYGYHMH**WVRQAPGQGLEWMG*AINPYNHEIQYNQKFQG*RVTITADKSTTTAYMELSSLRSEDTAVYYCAR***GNGKWGDGAYRFFDF***WGQGTLVTVSS (SEQ ID NO: 8199) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYYC***SQSTHVPYT***FGGGTKVEIK (SEQ ID NO: 8200) |
| L2P1-F3 VH | QVQLVQSGAEVKKPGSSVKVSCKAS**PRGFHGYHMH**WVRQAPGQGLEWMG*FINPYNDDIQYNQKFQG*RVTITADESTSTAYMELSSLRSEDTAVYYCAR***GNGKWGDGAYRFFDF***WGQGTLVTVSS (SEQ ID NO: 8201) |
| VL | DVVMTQSPLSLPVTPGEPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8202) |
| L2P1-F5 VH | QVQLVQSGAEVKKPGSSVKVSCKAS**PRGFYGYHMH**WVRQAPGQGLEWMG*FINPYNDDIQYNQKFQG*RVTITADESTSTAYMELSSLRSEDTAVYYCAM***GNGKWGDGAYRFFDL***WGQGTLVTVSS (SEQ ID NO: 8203) |
| aTRBC2e75 VL | DVVMTQSPLSLPVTLGQPASISC**RSSQNLVHSNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8204) |
| L2P1-H8 VH | QVQLVQSGAEVKKPGSSVKVSCKAS**PRGFYGYHMH**WVRQAPGQGLEWMG*FINPYNHAIKYNQKFQG*RVTITADESTSTAYMELSSLRSEDTAVYYCAR***GNGKWGDGAYRFFDF***WGQGTLVTVSS (SEQ ID NO: 8205) |
| VL | DVVMTQSPLSLPVTPGEPASISC**RSSQNLVHISNGRTYLQ**WYLQKPGQSPQLLIY*RVSNRF*PGVPDRFSGSGSGTDFTLKISRVEAEDVGVYFC***SQSTHVPYT***FGGGTKVEIK (SEQ ID NO: 8206) |

In some embodiments, the bispecific antibody is a humanized antibody.

In some embodiments, the first antigen binding domain has a higher affinity for a T cell receptor comprising TRBC2 than for a T cell receptor not comprising TRBC2, optionally wherein the KD for the binding between the first antigen binding domain and TRBC2 is no more than 40%, 30%, 20%, 10%, 1%, 0.10%, or 0.010% of the KD for the binding between the first antigen binding domain and a T cell receptor not comprising TRBC2. In some embodiments, the first antigen binding domain has a higher affinity for a T cell receptor comprising TRBC2 than for a T cell receptor comprising TCRBC1, optionally wherein the $K_D$ for the binding between the first antigen binding domain and TRBC2 is no more than 40%, 30%, 20%, 10%, 1%, 0.10%, or 0.010% of the $K_D$ for the binding between the first antigen binding domain and a T cell receptor comprising TCRBC1. In some embodiments, binding of the first antigen binding domain to TRBC2 on a lymphoma cell or lymphocyte, e.g., T cell, does not appreciably activate the lymphoma cell or lymphocyte, e.g., T cell, e.g., as measured by T cell proliferation, expression of a T cell activation marker (e.g., CD69 or CD25), and/or expression of a cytokine (e.g., TNFα and IFNγ). In some embodiments, the multifunctional molecule does not activate NK cells or does not substantially activate NK cells in the absence of a TRBC2-expressing cell.

In some embodiments, the antigen-binding domain may comprise a mutation or a combination of the following mutations:

T28K, Y32F, A100N, Y27N in the VH domain,
T28K, Y32F, A100N, G3 1K in the VH domain,
T28K, Y32F, A100N, Y27M in the VH domain,
T28K, Y32F, A100N, Y27W in the VH domain,
T28K, Y32F, A100N in the VH domain,
T28K, Y32F, A100N in the VH domain and R55K in the VL domain,
T28K, Y32F, A100N in the VH domain and N35K in the VL domain,
T28K, Y32F, A100N, N103H in the VH domain,
T28K, Y32F, A100N, N103A in the VH domain, T28K, Y32F, A100N, N103Y in the VH domain,
T28K, Y32F, A100N in the VH domain and N35R in the VL domain,
T28K, Y32F, A100N, N103S in the VH domain and N35M in the VL domain,
T28K, Y32F, A100N, N103M, in the VH domain,
T28K, Y32F, A100N, N103W in the VH domain and N35R in the VL domain,
T28K, Y32F, A100N in the VH domain and N35F in the VL domain,
T28K, Y32F, A100N, N103S in the VH domain and N35K in the VL domain,
T28K, Y32F, A100N, R98K in the VH domain,
T28K, Y32F, A100N, N103S in the VH domain and N35R in the VL domain,
T28K, Y32F, A100N, N103L in the VH domain,
T28K, Y32F, A100N, N103S in the VH domain and N35F in the VL domain,
T28K, Y32F, A100N, N103S in the VH domain and N35Y in the VL domain,
T28K, Y32F, A100N, N103L in the VH domain and N35M in the VL domain,
T28K, Y32F, A100N, N103L in the VH domain and N35R in the VL domain,
T28K, Y32F, A100N, N103W in the VH domain and N35K in the VL domain,
T28K, Y32F, A100N, N103L in the VH domain and N35Y in the VL domain,
T28K, Y32F, A100N, N103F in the VH domain,
T28K, Y32F, A100N, N103W in the VH domain,
T28K, Y32F, A100N, N103L in the VH domain and N35K in the VL domain,
T28K, Y32F, A100N, N103L in the VH domain and N35F in the VL domain,
T28K, Y32F, A100N, N103W in the VH domain and N35M in the VL domain,
T28K, Y32F, A100N, N103F in the VH domain and N35Y in the VL domain,
T28K, Y32F, A100N, Y27F in the VH domain,
T28K, Y32F, A100N, N103Q in the VH domain,
T28K, Y32F, A100N, N103S in the VH domain,
T28K, Y32F, A100N, N103M in the VH domain and N35F in the VL domain,
T28K, Y32F, A100N, N103F in the VH domain and N35M in the VL domain,
T28K, Y32F, A100N, N103F in the VH domain and N35F in the VL domain,
T28K, Y32F, A100N, G3 1R in the VH domain,
T28K, Y32F, A100N, N103W in the VH domain and N35F in the VL domain,
T28K, Y32F, A100N, V2R in the VH domain,
T28K, Y32F, A100N, G31S in the VH domain,
T28K, Y32F, A100N, A107S in the VH domain,
T28K, Y32F, A100N, N103E in the VH domain and N35M in the VL domain,
T28K, Y32F, A100N, V2K in the VH domain,
T28K, Y32F, A100N, N103E in the VH domain,
T28K, Y32F, A100N, Y102F, N103M in the VH domain and N35K in the VL domain,
T28K, Y32F, A100N, Y102F, N103M in the VH domain and N35F in the VL domain,
T28K, Y32F, A100N, Y102F, N103M in the VH domain and N35R in the VL domain,
T28K, Y32F, A100N, Y102F in the VH domain and N35R in the VL domain,
T28K, Y32F, A100N, N103M in the VH domain and N35M in the VL domain,
T28K, Y32F, A100N, N103M in the VH domain and N35Y in the VL domain,
T28K, Y32F, A100N, N103M in the VH domain and N35R in the VL domain,
T28K, Y32F, A100N, N103F in the VH domain and N35K in the VL domain,
T28K, Y32F, A100N, Y102L, N103W in the VH domain and N35R in the VL domain,
T28K, Y32F, A100N, Y102L, N103W in the VH domain and N35K in the VL domain,
T28K, Y32F, A100N, Y102F in the VH domain, and
T28K, Y32F, A100N, Y102L, N103M in the VH domain and N35R in the VL domain.

The residues describing the mutations as list above are considered with respect to a TCRBC1 or a TRBC2 wild type sequence. In some embodiments, the TCRBC1 or a TRBC2 wild type sequences or reference sequences. In some embodiments, the reference VH and VL sequences as depicted in SEQ ID NO: 8024 and SEQ ID NO:8025 respectively.

In some embodiments, the bispecific antibody comprises: (i) a first antigen binding domain comprising an scFv that binds to TRBC2 domain, and may comprise a heavy chain amino acid sequence that is at least 85%, 90%, 95%, 96%, 97%, 98%, 99% identical to the amino acid sequence:

```
                                   (SEQ ID NO: 8669, 8001)
QVQLVQSGAEVKKPGSSVKVSCKASPRGFYGYVMHWVRQAPGQGLEWMGF
INPYTNDIQYNERFRGRVTITSDKSTTTAYMELSSLRSEDTAVYYCARGN
GKWGDGAYRFFDLWGQGTLVTVSSASTKGPSVFPLAPSSKSTSGGTAALG
CLVKDYFPEPVTVSWNSGALTSGVHTFPAVLQSSGLYSLSSVVTVPSSSL
GTQTYICNVNHKPSNTKVDKRVEPKSCDKTHTCPPCPAPELLGGPSVFLF
PPKPKDTLMISRTPEVTCVVVDVSHEDPEVKFNWYVDGVEVHNAKTKPRE
EQYASTYRVVSVLTVLHQDWLNGKEYKCKVSNKALPAPIEKTISKAKGQP
REPQVYTLPPCREEMTKNQVSLWCLVKGFYPSDIAVEWESNGQPENNYKT
TPPVLDSDGSFFLYSKLTVDKSRWQQGNVFSCSVMHEALHNHYTQKSLSL
SPGK.
```

In some embodiments, the bispecific antibody comprises: (i) a first antigen binding domain comprising an scFv that binds to TRBC2 domain, and may comprise a light chain amino acid sequence that is at least 85%, 90%, 95% 96%, 97% 98%, 99% identical to the amino acid sequence:

```
                                           (SEQ ID NO: 8002)
DVVMTQSPLSLPVTLGQPASISCRSSENLVHSNGRTYLQWYQQRPGQSPR
LLIYRVSNRFPGVPDRFSGSGSGTDFTLKISRVEAEDVGVYFCSQSSLEP
YTFGGGTKVEIKRTVAAPSVFIFPPSDEQLKSGTASVVCLLNNFYPREAK
VQWKVDNALQSGNSQESVTEQDSKDSTYSLSSTLTLSKADYEKHKVYACE
VTHQGLSSPVTKSFNRGEC.
```

In some embodiments, the bispecific antibody comprises: (ii) second antigen binding domain that binds to NKp30, comprising an scFv that binds to NKp30 having a sequence that is at least 85%, 90%, 95%, 96%, 97%, 98%, 99% identical to the amino acid sequence:

(SEQ ID NO: 8003)

```
EIQLLESGGGLVQPGGSLRLSCAVSGFSITTTGYHWNWVRQAPGKGLEWV

GYIYSSGSTSYNPSLKSRFTISRDTSKNTFYLQMNSLRAEDTAVYYCARG

DWHYFDYWGQGTMVTVSSGGGGSGGGGSGGGGSGGGGSDSVTTQSPLSLP

VTLGQPASISCSGEKLSDKYVHWYQQRPGQSPRMLIYENDRRPSGVPDRF

SGSNSGNDATLKISRVEAEDVGVYFCQFWDSTNSAVFGGGTKVEIKDKTH

TCPPCPAPELLGGPSVFLFPPKPKDTLMISRTPEVTCVVVDVSHEDPEVK

FNWYVDGVEVHNAKTKPREEQYASTYRVVSVLTVLHQDWLNGKEYKCKVS

NKALPAPIEKTISKAKGQPREPQVCTLPPSREEMTKNQVSLSCAVKGFYP

SDIAVEWESNGQPENNYKTTPPVLDSDGSFFLVSKLTVDKSRWQQGNVFS

CSVMHEALHNHYTQKSLSLSPGK.
```

In some embodiments, the first antigen binding domain has a higher affinity for a T cell receptor comprising TRBC2 than for a T cell receptor not comprising TRBC2, optionally wherein the KD for the binding between the first antigen binding domain and TRBC2 is no more than 40%, 30%, 20%, 10%, 1%, 0.10%, or 0.010% of the KD for the binding between the first antigen binding domain and a T cell receptor not comprising TRBC2. In some embodiments, the first antigen binding domain has a higher affinity for a T cell receptor comprising TRBC2 than for a T cell receptor comprising TCRBC1, optionally wherein the $K_D$ for the binding between the first antigen binding domain and TRBC2 is no more than 40%, 30%, 20%, 10%, 1%, 0.10%, or 0.010% of the $K_D$ for the binding between the first antigen binding domain and a T cell receptor comprising TCRBC1. In some embodiments, binding of the first antigen binding domain to TRBC2 on a lymphoma cell or lymphocyte, e.g., T cell, does not appreciably activate the lymphoma cell or lymphocyte, e.g., T cell, e.g., as measured by T cell proliferation, expression of a T cell activation marker (e.g., CD69 or CD25), and/or expression of a cytokine (e.g., TNFα and IFNγ). In some embodiments, the multifunctional molecule does not activate NK cells or does not substantially activate NK cells in the absence of a TRBC2-expressing cell.

In some embodiments, the multifunctional molecule binds to TRBC2 monovalently.

Antibody Molecules that Bind to TRBC1/TRBC2 and NKp30

Figure 29A:
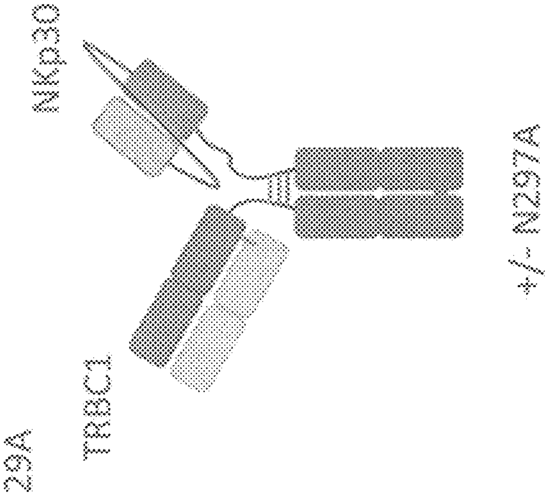
FIGS. 29A-29D are schematic representations of anti-TRBC1/NKp30 antibodies.
Figure 29B:
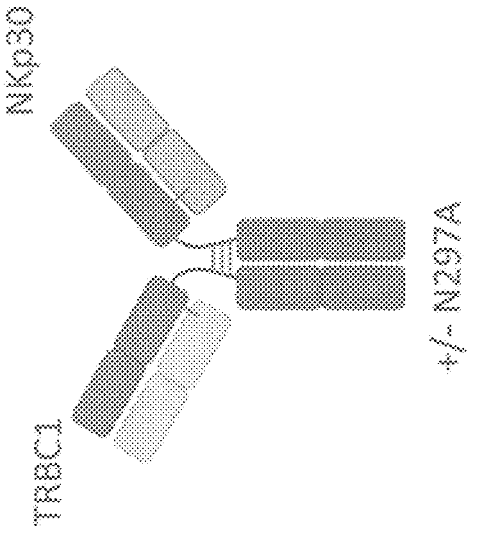
Figure 29C:
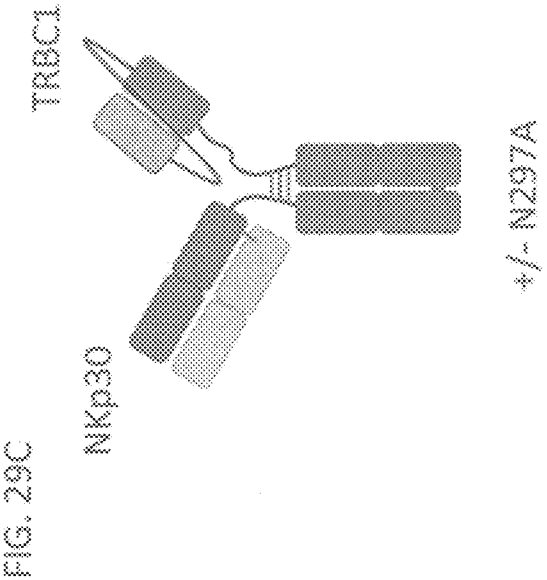
Figure 29D:
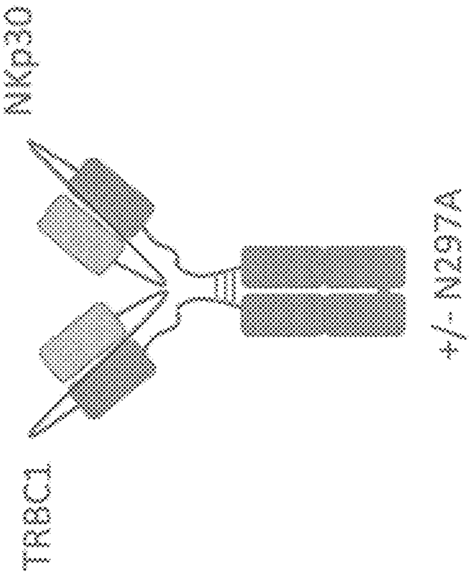

In some embodiments, the disclosure features a multifunctional antibody molecule that binds to TRBC1 and NKp30. In some embodiments, the multifunctional antibody molecule comprises a configuration shown in any of FIGS. 29A-29D. In some embodiments, the multifunctional antibody molecule comprises an anti-TRBC1 Fab. In some embodiments, the multifunctional antibody molecule comprises an anti-TRBC1 scFv. In some embodiments, the multifunctional antibody molecule comprises an anti-NKp30 Fab. In some embodiments, the multifunctional antibody molecule comprises an anti-NKp30 scFv. In some embodiments, the multifunctional antibody molecule comprises an anti-TRBC1 Fab and an anti-NKp30 scFv, e.g., comprises a configuration shown in FIG. 29A. In some embodiments, the multifunctional antibody molecule comprises an anti-TRBC1 Fab and an anti-NKp30 Fab, e.g., comprises a configuration shown in FIG. 29B. In some embodiments, the multifunctional antibody molecule comprises an anti-NKp30 Fab and an anti-TRBC1 scFv, e.g., comprises a configuration shown in FIG. 29C. In some embodiments, the multifunctional antibody molecule comprises an anti-TRBC1 scFv and an anti-NKp30 scFv, e.g., comprises a configuration shown in FIG. 29D. In some embodiments, the multifunctional antibody molecule comprises an anti-TRBC1 antigen binding domain disclosed herein, e.g., an anti-TRBC1 antigen binding domain disclosed in Table 1, Table 2A or Table 2B, Table 3A or Table 3B, Table 4, Table 7, Table 8. In some embodiments, the multifunctional antibody molecule comprises an anti-NKp30 antigen binding domain disclosed herein, e.g., an anti-NKp30 antigen binding domain disclosed in Table 16, Table 17, Table 20A or Table 20B, Table 21A or Table 21B, Table 22, Table 23A or Table 23B, Table 24, Table 25, Table 26.

In some embodiments, exemplary multifunctional antibody molecules that bind to TRBC1 and NKp30 are disclosed in Table 16.

In some embodiments, the multifunctional antibody molecule comprises an anti-TRBC1 VH of SEQ ID NO: 7351 (or a sequence having at least 85%, 90%, 95%, or 99% identity thereto), an anti-TRBC1 VL of SEQ ID NO: 258 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7309 (or a sequence having at least 85%, 90%, 95%, or 99% identity thereto). In some embodiments, the anti-TRBC1/NKp30 antibody molecule comprises an anti-TRBC1 VH of SEQ ID NO: 7351 (or a sequence having at least 85%, 90%, 95%, or 99% identity thereto), an anti-TRBC1 VL of SEQ ID NO: 258 (or a sequence having at least 85%, 90%, 95%, or 99% identity thereto), and an anti-NKp30 scFv of SEQ ID NO: 7311 (or a sequence having at least 85%, 90%, 95%, or 99% identity thereto). In some embodiments, the anti-TRBC1/NKp30 antibody molecule comprises SEQ ID NOs: 7382, 7380, and 7383 (or a sequence having at least 85%, 90%, 95%, or 99% identity thereto).

In some embodiments, the multifunctional antibody molecule comprises an anti-TRBC1 VH of SEQ ID NO: 253 (or a sequence having at least 85%, 90%, 95%, or 99% identity thereto), an anti-TRBC1 VL of SEQ ID NO: 258 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7309 (or a sequence having at least 85%, 90%, 95%, or 99% identity thereto). In some embodiments, the anti-TRBC1/NKp30 antibody molecule comprises an anti-TRBC1 VH of SEQ ID NO: 253 (or a sequence having at least 85%, 90%, 95%, or 99% identity thereto), an anti-TRBC1 VL of SEQ ID NO: 258 (or a sequence having at least 85%, 90%, 95%, or 99% identity thereto), and an anti-NKp30 scFv of SEQ ID NO: 7311 (or a sequence having at least 85%, 90%, 95%, or 99% identity thereto). In some embodiments, the anti-TRBC1/NKp30 antibody molecule comprises SEQ ID NOs: 7379, 7380, and 7383 (or a sequence having at least 85%, 90%, 95%, or 99% identity thereto).

In some embodiments, the multifunctional antibody molecule comprises an anti-TRBC1 VH of SEQ ID NO: 7351 (or a sequence having at least 85%, 90%, 95%, or 99% identity thereto), an anti-TRBC1 VL of SEQ ID NO: 258 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7305 (or a sequence having at least 85%, 90%, 95%, or 99% identity thereto). In some embodiments, the anti-TRBC1/NKp30 antibody molecule comprises an anti-TRBC1 VH of SEQ ID NO: 7351 (or a sequence having at least 85%, 90%, 95%, or 99% identity thereto), an anti-TRBC1 VL of SEQ ID NO: 258 (or a sequence having at least 85%, 90%, 95%, or 99% identity thereto), and an anti-NKp30 scFv of SEQ ID NO: 7310 (or a sequence having at least 85%, 90%, 95%, or 99% identity thereto). In some embodiments, the anti-TRBC1/NKp30 antibody molecule comprises SEQ ID NOs: 7382, 7380, and 7384 (or a sequence having at least 85%, 90%, 95%, or 99% identity thereto).

In some embodiments, the multifunctional antibody molecule comprises an anti-TRBC1 VH of SEQ ID NO: 253 (or a sequence having at least 85%, 90%, 95%, or 99% identity thereto), an anti-TRBC1 VL of SEQ ID NO: 258 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7305 (or a sequence having at least 85%, 90%, 95%, or 99% identity thereto). In some embodiments, the anti-TRBC1/NKp30 antibody molecule comprises an anti-TRBC1 VH of SEQ ID NO: 253 (or a sequence having at least 85%, 90%, 95%, or 99% identity thereto), an anti-TRBC1 VL of SEQ ID NO: 258 (or a sequence having at least 85%, 90%, 95%, or 99% identity thereto), and an anti-NKp30 scFv of SEQ ID NO: 7310 (or a sequence having at least 85%, 90%, 95%, or 99% identity thereto). In some embodiments, the anti-TRBC1/NKp30 antibody molecule comprises SEQ ID NOs: 7379, 7380, and 7384 (or a sequence having at least 85%, 90%, 95%, or 99% identity thereto).

In some embodiments provided herein is an antibody or a fragment thereof that binds to a TRBC1 molecule, wherein the antibody or fragment thereof that binds to the TRBC1 comprises a heavy chain comprising an HC-CDR1, having a sequence GYVMH (SEQ ID NO 8643); an HC-CDR2, having a sequence of FINPYNDDIQSNERFRG (SEQ ID NO: 8644); and an HC-CDR3, having a sequence of GAGYNFDGAYRFFDF (SEQ ID NO: 8645); and a light chain comprising an LC-CDR1 of RSSQRLVHSNGNTYLH (SEQ ID NO: 8646), an LC-CDR2 of RVSNRFP (SEQ ID NO: 8647), an LC-CDR3 of SEQ ID NO: SQSTHVPYT (SEQ ID NO: 8648).

In some embodiments provided herein is an antibody or a fragment thereof that binds to a TRBC1 molecule, wherein the antibody or fragment thereof that binds to the TRBC1 comprises a heavy chain comprising an HC-CDR1, having a sequence GYVMH (SEQ ID NO 8643); an HC-CDR2, having a sequence FIIPIFGTANYAQKFQG (SEQ ID NO: 8649) and an HC-CDR3, having a sequence GAGYNFDGAYRFFDF (SEQ ID NO: 8650); and a light chain comprising an LC-CDR1 having a sequence, RSSQRLVHSNGNTYLH (SEQ ID NO: 8651), an LC-CDR2 having sequence RVSNRFP (SEQ ID NO: 8652), and an LC-CDR3 having a sequence SQSTHVPYT (SEQ ID NO: 8653).

In some embodiments, provided herein is an antibody or a fragment thereof that binds to a TRBC1 molecule, wherein the antibody or fragment thereof that binds to the TRBC1 comprises a heavy chain comprising an HC-CDR1, having a sequence GYVMH (SEQ ID NO 8643); an HC-CDR2, having a sequence FINPYNDDIQSNERFRG (SEQ ID NO: 8654) and an HC-CDR3, having a sequence GAGYNFDGAYRFFDF (SEQ ID NO: 8655); and a light chain comprising an LC-CDR1 having a sequence, RSSQRLVHSNGNTYLH (SEQ ID NO: 8656), an LC-CDR2 having sequence RVSNRFP (SEQ ID NO: 8657), and an LC-CDR3 having a sequence SQSTHVPYT (SEQ ID NO: 8658).

In some embodiments, provided herein is an antibody or a fragment thereof that binds to a TRBC1 molecule, wherein the antibody or fragment thereof that binds to the TRBC1 comprises a heavy chain comprising an HC-CDR1, having a sequence GYVMH (SEQ ID NO 8643); an HC-CDR2, having a sequence FIIPIFGTANYAQKFQG (SEQ ID NO: 8659) and an HC-CDR3, having a sequence GAGYNFDGAYRFFDF (SEQ ID NO: 8660); and a light chain comprising an LC-CDR1 having a sequence, RSSQRLVHSNGNTYLH (SEQ ID NO: 8661), an LC-CDR2 having sequence RVSNRFP (SEQ ID NO: 8662), and an LC-CDR3 having a sequence SQSTHVPYT (SEQ ID NO: 8663).

In some embodiments, provided herein is an antibody or a fragment thereof that binds to a TRBC1 molecule, wherein the antibody or fragment thereof that binds to the TRBC1 comprises a heavy chain comprising an HC-CDR1, having a sequence GYVMH (SEQ ID NO 8643); an HC-CDR2, having a sequence FINPYNDDIQSNERFRG (SEQ ID NO: 8664) and an HC-CDR3, having a sequence GAGYNFDGAYRFFDF (SEQ ID NO: 8665); and a light chain comprising an LC-CDR1 having a sequence, RSSQRLVHSNGNTYLH (SEQ ID NO: 8666), an LC-CDR2 having sequence RVSNRFP (SEQ ID NO: 8667), and an LC-CDR3 having a sequence SQSTHVPYT (SEQ ID NO: 8668).

TABLE 16

Exemplary antibody molecules that bind to TRBC1 AND/OR NKp30

| SEQ ID NO | Description | Sequence |
|---|---|---|
| | | Anti-TRBC1-NKp30-BJM0772 |
| SEQ ID NO: 7379 | anti-TRBC1 HC | QVQLVQSGAEVKKPGSSVKVSCKASGYTFT**GYVMH**WVRQAPGQ GLEWMG**FINPYNDDIQSNERFRG**RVTITSDKSTTTAYMELSSLRSE DTAVYYCAR**GAGYNFDGAYRFFDF**WGQGTLVTVSSASTKGPSVF PLAPSSKSTSGGTAALGCLVKDYFPEPVTVSWNSGALTSGVHTFPA VLQSSGLYSLSSVVTVPSSSLGTQTYICNVNHKPSNTKVDKRVEPK SCDKTHTCPPCPAPELLGGPSVFLFPPKPKDTLMISRTPEVTCVVVD VSHEDPEVKFNWYVDGVEVHNAKTKPREEQYASTYRVVSVLTVL HQDWLNGKEYKCKVSNKALPAPIEKTISKAKGQPREPQVYTLPPC REEMTKNQVSLWCLVKGFYPSDIAVEWESNGQPENNYKTTPPVLD SDGSFFLYSKLTVDKSRWQQGNVFSCSVMHEALHNHYTQKSLSLS PGK |
| SEQ ID NO: 7380 | anti-TRBC1 LC | DVVMTQSPLSLPVTLGQPASISC**RSSQRLVHSNGNTYLH**WYQQRP GQSPRLLIY**RVSNRFP**GVPDRFSGSGSGTDFTLKISRVEAEDVGVY FC**SQSTHVPYT**FGGGTKVEIKRTVAAPSVFIFPPSDEQLKSGTASVV CLLNNFYPREAKVQWKVDNALQSGNSQESVTEQDSKDSTYSLSST LTLSKADYEKHKVYACEVTHQGLSSPVTKSFNRGEC |

TABLE 16-continued

Exemplary antibody molecules that bind to TRBC1 AND/OR NKp30

| SEQ ID NO | Description | Sequence |
|---|---|---|
| SEQ ID NO: 7381 | anti-NKp30 15E1 scFv-Fc | QIQLQESGPGLVKPSQSLSLSCSVTGFSITTTGYHWNWIRQFPGKKL<br>EWMGYIYSSGSTSYNPSLKSRFSITRDTSKNQFFLQLNSVTTEDTAT<br>YYCARGDWHYFDYWGPGTMVTVSSGGGGSGGGGSGGGGSGGG<br>GSSFTLTQPPLVSVAVGQVATITCSGEKLSDKYVHWYQQKPGRAP<br>VMVIYENDRRPSGIPDQFSGSNSGNIASLTISKAQAGDEADYFCQF<br>WDSTNSAVFGGGTQLTVLDKTHTCPPCPAPELLGGPSVFLFPPKPK<br>DTLMISRTPEVTCVVVDVSHEDPEVKFNWYVDGVEVHNAKTKPR<br>EEQYASTYRVVSVLTVLHQDWLNGKEYKCKVSNKALPAPIEKTIS<br>KAKGQPREPQVCTLPPSREEMTKNQVSLSCAVKGFYPSDIAVEWE<br>SNGQPENNYKTTPPVLDSDGSFFLVSKLTVDKSRWQQGNVFSCSV<br>MHEALHNRFTQKSLSLSPGK |
| | | Anti-TRBC1-NKp30-BJM1042 |
| SEQ ID NO: 7382 | anti-TRBC1 HC | QVQLVQSGAEVKKPGSSVKVSCKASGYTFT**GYVMH**WVRQAPGQ<br>GLEWMG**FIIPIFGTANYAQKFQG**RVTITSDKSTTTAYMELSSLRSE<br>DTAVYYCAR**GAGYNFDGAYRFFDF**WGQGTLVTVSSASTKGPSVF<br>PLAPSSKSTSGGTAALGCLVKDYFPEPVTVSWNSGALTSGVHTFPA<br>VLQSSGLYSLSSVVTVPSSSLGTQTYICNVNHKPSNTKVDKRVEPK<br>SCDKTHTCPPCPAPELLGGPSVFLFPPKPKDTLMISRTPEVTCVVVD<br>VSHEDPEVKFNWYVDGVEVHNAKTKPREEQYASTYRVVSVLTVL<br>HQDWLNGKEYKCKVSNKALPAPIEKTISKAKGQPREPQVYTLPPC<br>REEMTKNQVSLWCLVKGFYPSDIAVEWESNGQPENNYKTTPPVLD<br>SDGSFFLYSKLTVDKSRWQQGNVFSCSVMHEALHNHYTQKSLSLS<br>PGK |
| SEQ ID NO: 7380 | anti-TRBC1 LC | DVVMTQSPLSLPVTLGQPASISC**RSSQRLVHSNGNTYLH**WYQQRP<br>GQSPRLLIY**RVSNRFP**GVPDRFSGSGSGTDFTLKISRVEAEDVGVY<br>FC**SQSTHVPYT**FGGGTKVEIKRTVAAPSVFIFPPSDEQLKSGTASVV<br>CLLNNFYPREAKVQWKVDNALQSGNSQESVTEQDSKDSTYSLSST<br>LTLSKADYEKHKVYACEVTHQGLSSPVTKSFNRGEC |
| SEQ ID NO: 7383 | anti-NKp30 humanized 15E1 scFv-Fc | EIQLLESGGGLVQPGGSLRLSCAVSGFSITTTGYHWNWVRQAPGK<br>GLEWVGYIYSSGSTSYNPSLKSRFTISRDTSKNTFYLQMNSLRAED<br>TAVYYCARGDWHYFDYWGQGTMVTVSSGGGGSGGGGSGGGGS<br>GGGGSDSVTTQSPLSLPVTLGQPASISCSGEKLSDKYVHWYQQRPG<br>QSPRMLIYENDRRPSGVPDRFSGSNSGNDATLKISRVEAEDVGVYF<br>CQFWDSTNSAVFGGGTKVEIKDKTHTCPPCPAPELLGGPSVFLFPP<br>KPKDTLMISRTPEVTCVVVDVSHEDPEVKFNWYVDGVEVHNAKT<br>KPREEQYASTYRVVSVLTVLHQDWLNGKEYKCKVSNKALPAPIEK<br>TISKAKGQPREPQVCTLPPSREEMTKNQVSLSCAVKGFYPSDIAVE<br>WESNGQPENNYKTTPPVLDSDGSFFLVSKLTVDKSRWQQGNVFSC<br>SVMHEALHNHYTQKSLSLSPGK |
| | | Anti-TRBC1-NKp30-BJM1052 |
| SEQ ID NO: 7379 | anti-TRBC1 HC | QVQLVQSGAEVKKPGSSVKVSCKASGYTFT**GYVMH**WVRQAPGQ<br>GLEWMG**FINPYNDDIQSNERFRG**RVTITSDKSTTTAYMELSSLRSE<br>DTAVYYCAR**GAGYNFDGAYRFFDF**WGQGTLVTVSSASTKGPSVF<br>PLAPSSKSTSGGTAALGCLVKDYFPEPVTVSWNSGALTSGVHTFPA<br>VLQSSGLYSLSSVVTVPSSSLGTQTYICNVNHKPSNTKVDKRVEPK<br>SCDKTHTCPPCPAPELLGGPSVFLFPPKPKDTLMISRTPEVTCVVVD<br>VSHEDPEVKFNWYVDGVEVHNAKTKPREEQYASTYRVVSVLTVL<br>HQDWLNGKEYKCKVSNKALPAPIEKTISKAKGQPREPQVYTLPPC<br>REEMTKNQVSLWCLVKGFYPSDIAVEWESNGQPENNYKTTPPVLD<br>SDGSFFLYSKLTVDKSRWQQGNVFSCSVMHEALHNHYTQKSLSLS<br>PGK |
| SEQ ID NO: 7380 | anti-TRBC1 LC | DVVMTQSPLSLPVTLGQPASISC**RSSQRLVHSNGNTYLH**WYQQRP<br>GQSPRLLIY**RVSNRFP**GVPDRFSGSGSGTDFTLKISRVEAEDVGVY<br>FC**SQSTHVPYT**FGGGTKVEIKRTVAAPSVFIFPPSDEQLKSGTASVV<br>CLLNNFYPREAKVQWKVDNALQSGNSQESVTEQDSKDSTYSLSST<br>LTLSKADYEKHKVYACEVTHQGLSSPVTKSFNRGEC |
| SEQ ID NO: 7383 | anti-NKp30 humanized 15E1 scFv-Fc | EIQLLESGGGLVQPGGSLRLSCAVSGFSITTTGYHWNWVRQAPGK<br>GLEWVGYIYSSGSTSYNPSLKSRFTISRDTSKNTFYLQMNSLRAED<br>TAVYYCARGDWHYFDYWGQGTMVTVSSGGGGGGGGSGGGGS<br>GGGGSDSVTTQSPLSLPVTLGQPASISCSGEKLSDKYVHWYQQRPG<br>QSPRMLIYENDRRPSGVPDRFSGSNSGNDATLKISRVEAEDVGVYF<br>CQFWDSTNSAVFGGGTKVEIKDKTHTCPPCPAPELLGGPSVFLFPP<br>KPKDTLMISRTPEVTCVVVDVSHEDPEVKFNWYVDGVEVHNAKT<br>KPREEQYASTYRVVSVLTVLHQDWLNGKEYKCKVSNKALPAPIEK<br>TISKAKGQPREPQVCTLPPSREEMTKNQVSLSCAVKGFYPSDIAVE<br>WESNGQPENNYKTTPPVLDSDGSFFLVSKLTVDKSRWQQGNVFSC<br>SVMHEALHNHYTQKSLSLSPGK |

TABLE 16-continued

Exemplary antibody molecules that bind to TRBC1 AND/OR NKp30

| SEQ ID NO | Description | Sequence |
|---|---|---|
| | | Anti-TRBC1-NKp30-BJM1038 |
| SEQ ID NO: 7382 | anti-TRBC1 HC | QVQLVQSGAEVKKPGSSVKVSCKASGYTFT**GYVMH**WVRQAPGQ<br>GLEWMG**FIIPIFGTANYAQKFQG**RVTITSDKSTTTAYMELSSLRSE<br>DTAVYYCAR**GAGYNFDGAYRFFDF**WGQGTLVTVSSASTKGPSVF<br>PLAPSSKSTSGGTAALGCLVKDYFPEPVTVSWNSGALTSGVHTFPA<br>VLQSSGLYSLSSVVTVPSSSLGTQTYICNVNHKPSNTKVDKRVEPK<br>SCDKTHTCPPCPAPELLGGPSVFLFPPKPKDTLMISRTPEVTCVVVD<br>VSHEDPEVKFNWYVDGVEVHNAKTKPREEQYASTYRVVSVLTVL<br>HQDWLNGKEYKCKVSNKALPAPIEKTISKAKGQPREPQVYTLPPC<br>REEMTKNQVSLWCLVKGFYPSDIAVEWESNGQPENNYKTTPPVLD<br>SDGSFFLYSKLTVDKSRWQQGNVFSCSVMHEALHNHYTQKSLSLS<br>PGK |
| SEQ ID NO: 7380 | anti-TRBC1 LC | DVVMTQSPLSLPVTLGQPASISC**RSSQRLVHSNGNTYLH**WYQQRP<br>GQSPRLLIY**RVSNRFP**GVPDRFSGSGSGTDFTLKISRVEAEDVGVY<br>FC**SQSTHVPYT**FGGGTKVEIKRTVAAPSVFIFPPSDEQLKSGTASVV<br>CLLNNFYPREAKVQWKVDNALQSGNSQESVTEQDSKDSTYSLSST<br>LTLSKADYEKHKVYACEVTHQGLSSPVTKSFNRGEC |
| SEQ ID NO: 7384 | anti-NKp30 humanized 15E1 scFv-Fc | EIQLLESGGGLVQPGGSLRLSCAVSGFSITTTGYHWNWVRQAPGK<br>GLEWVGYIYSSGSTSYNPSLKSRFTISRDTSKNTFYLQMNSLRAED<br>TAVYYCARGDWHYFDYWGQGTMVTVSSGGGGSGGGGSGGGGS<br>GGGGSSSETTQPPSVSVSPGQTASITCSGEKLSDKYVHWYQQKPGQ<br>SPVMVIYENDRRPSGIPERFSGSNSGNTATLTISGTQAMDEADYFC<br>QFWDSTNSAVFGGGTQLTVLDKTHTCPPCPAPELLGGPSVFLFPPK<br>PKDTLMISRTPEVTCVVVDVSHEDPEVKFNWYVDGVEVHNAKTK<br>PREEQYASTYRVVSVLTVLHQDWLNGKEYKCKVSNKALPAPIEKT<br>ISKAKGQPREPQVCTLPPSREEMTKNQVSLSCAVKGFYPSDIAVEW<br>ESNGQPENNYKTTPPVLDSDGSFFLVSKLTVDKSRWQQGNVFSCS<br>VMHEALHNHYTQKSLSLSPGK |
| | | Anti-TRBC1-NKp30-BJM1048 |
| SEQ ID NO: 7379 | anti-TRBC1 HC | QVQLVQSGAEVKKPGSSVKVSCKASGYTFT**GYVMH**WVRQAPGQ<br>GLEWMG**FINPYNDDIQSNERFRG**RVTITSDKSTTTAYMELSSLRSE<br>DTAVYYCAR**GAGYNFDGAYRFFDF**WGQGTLVTVSSASTKGPSVF<br>PLAPSSKSTSGGTAALGCLVKDYFPEPVTVSWNSGALTSGVHTFPA<br>VLQSSGLYSLSSVVTVPSSSLGTQTYICNVNHKPSNTKVDKRVEPK<br>SCDKTHTCPPCPAPELLGGPSVFLFPPKPKDTLMISRTPEVTCVVVD<br>VSHEDPEVKFNWYVDGVEVHNAKTKPREEQYASTYRVVSVLTVL<br>HQDWLNGKEYKCKVSNKALPAPIEKTISKAKGQPREPQVYTLPPC<br>REEMTKNQVSLWCLVKGFYPSDIAVEWESNGQPENNYKTTPPVLD<br>SDGSFFLYSKLTVDKSRWQQGNVFSCSVMHEALHNHYTQKSLSLS<br>PGK |
| SEQ ID NO: 7380 | anti-TRBC1 LC | DVVMTQSPLSLPVTLGQPASISC**RSSQRLVHSNGNTYLH**WYQQRP<br>GQSPRLLIY**RVSNRFP**GVPDRFSGSGSGTDFTLKISRVEAEDVGVY<br>FC**SQSTHVPYT**FGGGTKVEIKRTVAAPSVFIFPPSDEQLKSGTASVV<br>CLLNNFYPREAKVQWKVDNALQSGNSQESVTEQDSKDSTYSLSST<br>LTLSKADYEKHKVYACEVTHQGLSSPVTKSFNRGEC |
| SEQ ID NO: 7384 | anti-NKp30 humanized 15E1 scFv-Fc | EIQLLESGGGLVQPGGSLRLSCAVSGFSITTTGYHWNWVRQAPGK<br>GLEWVGYIYSSGSTSYNPSLKSRFTISRDTSKNTFYLQMNSLRAED<br>TAVYYCARGDWHYFDYWGQGTMVTVSSGGGGSGGGGSGGGGS<br>GGGGSSSETTQPPSVSVSPGQTASITCSGEKLSDKYVHWYQQKPGQ<br>SPVMVIYENDRRPSGIPERFSGSNSGNTATLTISGTQAMDEADYFC<br>QFWDSTNSAVFGGGTQLTVLDKTHTCPPCPAPELLGGPSVFLFPPK<br>PKDTLMISRTPEVTCVVVDVSHEDPEVKFNWYVDGVEVHNAKTK<br>PREEQYASTYRVVSVLTVLHQDWLNGKEYKCKVSNKALPAPIEKT<br>ISKAKGQPREPQVCTLPPSREEMTKNQVSLSCAVKGFYPSDIAVEW<br>ESNGQPENNYKTTPPVLDSDGSFFLVSKLTVDKSRWQQGNVFSCS<br>VMHEALHNHYTQKSLSLSPGK |

Figure 30A:
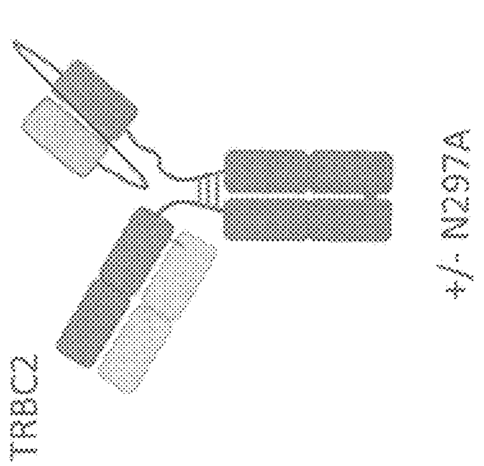
FIGS. 30A-30D are schematic representations of anti-TRBC2/NKp30 antibodies.
Figure 30B:
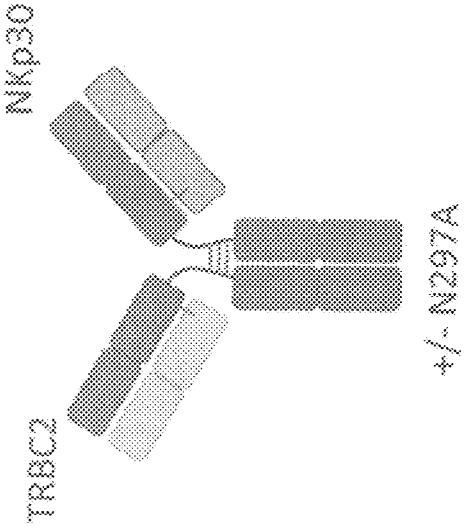
Figure 30C:
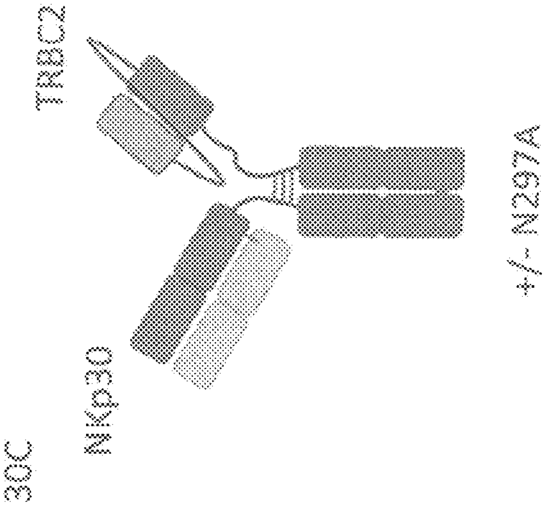
Figure 30D:
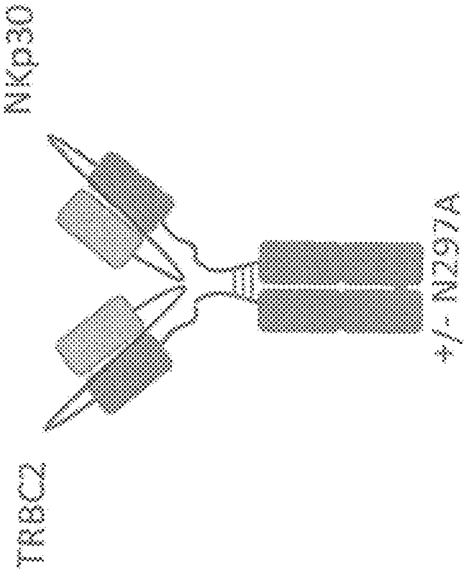

In some embodiments, the disclosure features a multifunctional antibody molecule that binds to both TRBC2 and NKp30. In some embodiments, the multifunctional antibody molecule comprises a configuration shown in any of FIGS. 30A-30D. In some embodiments, the multifunctional antibody molecule comprises an anti-TRBC2 Fab. In some embodiments, the multifunctional antibody molecule comprises an anti-TRBC2 scFv. In some embodiments, the multifunctional antibody molecule comprises an anti-NKp30 Fab. In some embodiments, the multifunctional antibody molecule comprises an anti-NKp30 scFv. In some embodiments, the multifunctional antibody molecule comprises an anti-TRBC2 Fab and an anti-NKp30 scFv, e.g., comprises a configuration shown in FIG. 30A. In some embodiments, the multifunctional antibody molecule comprises an anti-TRBC2 Fab and an anti-NKp30 Fab, e.g., comprises a configuration shown in FIG. 30B. In some embodiments, the multifunctional antibody molecule comprises an anti-NKp30 Fab and an anti-TRBC2 scFv, e.g., comprises a configuration shown in FIG. 30C. In some embodiments, the multifunctional antibody molecule comprises an anti-TRBC2 scFv and an anti-NKp30 scFv, e.g., comprises a configuration shown in FIG. 30D. In some embodiments, the multifunctional antibody molecule comprises an anti-TRBC2 antigen binding domain disclosed herein, e.g., an anti-TRBC2 antigen binding domain disclosed in Table 9A or Table 9B3, Table 10, Table 11, Table 12, Table 13, Table 14, table 15, Table 17, Table 39. In some embodiments, the multifunctional antibody molecule comprises an anti-NKp30 antigen binding domain disclosed herein, e.g., an anti-NKp30 antigen binding domain disclosed in Table 20A or Table 201B, Table 22, Table 23A or Table 23B3, Table 24, Table 25, Table 26, Table 21A or Table 21B, and Table 17.

In some embodiments, exemplary multifunctional antibody molecules that bind to TRBC2 and NKp30 are disclosed in Table 17.

In some embodiments, the multifunctional antibody molecule comprises an anti-TRBC2 VH of SEQ ID NO: 7420 (or a sequence having at least 85%, 90%, 95%, or 99% identity thereto), an anti-TRBC2 VL of SEQ ID NO: 7419 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7309 (or a sequence having at least 85%, 90%, 95%, or 99% identity thereto). In some embodiments, the anti-TRBC2/NKp30 antibody molecule comprises an anti-TRBC2 VH of SEQ ID NO: 7420 (or a sequence having at least 85%, 90%, 95%, or 99% identity thereto), an anti-TRBC2 VL of SEQ ID NO: 7419 (or a sequence having at least 85%, 90%, 95%, or 99% identity thereto), and an anti-NKp30 scFv of SEQ ID NO: 7311 (or a sequence having at least 85%, 90%, 95%, or 99% identity thereto). In some embodiments, the anti-TRBC2/NKp30 antibody molecule comprises SEQ ID NOs: 7438, 7439, and 7383 (or a sequence having at least 85%, 90%, 95%, or 99% identity thereto).

In some embodiments, the multifunctional antibody molecule comprises an anti-TRBC2 VH of SEQ ID NO: 7423 (or a sequence having at least 85%, 90%, 95%, or 99% identity thereto), an anti-TRBC2 VL of SEQ ID NO: 7419 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7309 (or a sequence having at least 85%, 90%, 95%, or 99% identity thereto). In some embodiments, the anti-TRBC2/NKp30 antibody molecule comprises an anti-TRBC2 VH of SEQ ID NO: 7423 (or a sequence having at least 85%, 90%, 95%, or 99% identity thereto), an anti-TRBC2 VL of SEQ ID NO: 7419 (or a sequence having at least 85%, 90%, 95%, or 99% identity thereto), and an anti-NKp30 scFv of SEQ ID NO: 7311 (or a sequence having at least 85%, 90%, 95%, or 99% identity thereto). In some embodiments, the anti-TRBC2/NKp30 antibody molecule comprises SEQ ID NOs: 7440, 7439, and 7383 (or a sequence having at least 85%, 90%, 95%, or 99% identity thereto).

In some embodiments, the multifunctional antibody molecule comprises an anti-TRBC2 VH of SEQ ID NO: 7420 (or a sequence having at least 85%, 90%, 95%, or 99% identity thereto), an anti-TRBC2 VL of SEQ ID NO: 7419 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7305 (or a sequence having at least 85%, 90%, 95%, or 99% identity thereto). In some embodiments, the anti-TRBC2/NKp30 antibody molecule comprises an anti-TRBC2 VH of SEQ ID NO: 7420 (or a sequence having at least 85%, 90%, 95%, or 99% identity thereto), an anti-TRBC2 VL of SEQ ID NO: 7419 (or a sequence having at least 85%, 90%, 95%, or 99% identity thereto), and an anti-NKp30 scFv of SEQ ID NO: 7310 (or a sequence having at least 85%, 90%, 95%, or 99% identity thereto). In some embodiments, the anti-TRBC2/NKp30 antibody molecule comprises SEQ ID NOs: 7438, 7439, and 7384 (or a sequence having at least 85%, 90%, 95%, or 99% identity thereto).

In some embodiments, the multifunctional antibody molecule comprises an anti-TRBC2 VH of SEQ ID NO: 7423 (or a sequence having at least 85%, 90%, 95%, or 99% identity thereto), an anti-TRBC2 VL of SEQ ID NO: 7419 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7305 (or a sequence having at least 85%, 90%, 95%, or 99% identity thereto). In some embodiments, the anti-TRBC2/NKp30 antibody molecule comprises an anti-TRBC2 VH of SEQ ID NO: 7423 (or a sequence having at least 85, 90G, 95V or 99 identity thereto), an anti-TRBC2 VL of SEQ ID NO: 7419 (or a sequence having at least 85%, 90%, 95%, or 99% identity thereto), and an anti-NKp30 scFv of SEQ ID NO: 7310 (or a sequence having at least 85%, 90%, 95%, or 99% identity thereto). In some embodiments, the anti-TRBC2/NKp30 antibody molecule comprises SEQ ID NOs: 7440, 7439, and 7384 (or a sequence having at least 85D, 90S, 95 or 99 identity thereto).

TABLE 17

Exemplary multispecific antibody molecules or parts thereof that bind to TRBC2 AND/OR NKp30

| SEQ ID NO | Description | Sequence |
|---|---|---|
| | | Anti-TRBC2-NKp30-BKM0097 |
| SEQ ID NO: 7438 | Anti-TRBC2 HC | QVQLVQSGAEVKKPGASVKVSCKASTSGFHGYPMHWVRQAP GQGLEWMGFINPYNDDIQSNERFRGRVTMTSDKSTTTAYMEL SSLRSEDTAVYYCARGNGKWGDGAYRFFDFWGQGTLVTVSS ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKRVEPKSCDKTHTCPPCPAPELLGGPSVFLFPPKPK DTLMISRTPEVTCVVVDVSHEDPEVKFNWYVDGVEVHNAKTK PREEQYASTYRVVSVLTVLHQDWLNGKEYKCKVSNKALPAPI EKTISKAKGQPREPQVYTLPPCREEMTKNQVSLWCLVKGFYPS DIAVEWESNGQPENNYKTTPPVLDSDGSFFLYSKLTVDKSRWQ QGNVFSCSVMHEALHNHYTQKSLSLSPGK |
| SEQ ID NO: 7439 | Anti-TRBC2 LC | DVVMTQSPLSLPVTPGEPASISCRSSQNLVHSNGRTYLQWYLQ KPGQSPQLLIYRVSNRFPGVPDRFSGSGSGTDFTLKISRVEAED VGVYFCSQSTHVPYTFGGGTKVEIKRTVAAPSVFIFPPSDEQLK |

TABLE 17-continued

| Exemplary multispecific antibody molecules or parts thereof that bind to TRBC2 AND/OR NKp30 | | |
|---|---|---|
| SEQ ID NO | Description | Sequence |
| | | SGTASVVCLLNNFYPREAKVQWKVDNALQSGNSQESVTEQDS KDSTYSLSSTLTLSKADYEKHKVYACEVTHQGLSSPVTKSFNR GEC |
| SEQ ID NO: 7383 | anti-NKp30 humanized 15E1 scFv-Fc | EIQLLESGGGLVQPGGSLRLSCAVSGFSITTTGYHWNWVRQAP GKGLEWVGYIYSSGSTSYNPSLKSRFTISRDTSKNTFYLQMNSL RAEDTAVYYCARGDWHYFDYWGQGTMVTVSSGGGGSGGGG SGGGGSGGGGSDSVTTQSPLSLPVTLGQPASISCSGEKLSDKYV HWYQQRPGQSPRMLIYENDRRPSGVPDRFSGSNSGNDATLKIS RVEAEDVGVYFCQFWDSTNSAVFGGGTKVEIKDKTHTCPPCP APELLGGPSVFLFPPKPKDTLMISRTPEVTCVVVDVSHEDPEVK FNWYVDGVEVHNAKTKPREEQYASTYRVVSVLTVLHQDWLN GKEYKCKVSNKALPAPIEKTISKAKGQPREPQVCTLPPSREEMT KNQVSLSCAVKGFYPSDIAVEWESNGQPENNYKTTPPVLDSDG SFFLVSKLTVDKSRWQQGNVFSCSVMHEALHNHYTQKSLSLSP GK |
| Anti-TRBC2-NKp30-BKM0098 | | |
| SEQ ID NO: 7440 | Anti-TRBC2 HC | QVQLVQSGAEVKKPGASVKVSCKASPRGFHGYHMHWVRQAP GQGLEWMGFINPYNDDIQSNERFRGRVTMTSDKSTTTAYMEL SSLRSEDTAVYYCARGNGKWGDGAYRFFDFWGQGTLVTVSS ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKRVEPKSCDKTHTCPPCPAPELLGGPSVFLFPPKPK DTLMISRTPEVTCVVVDVSHEDPEVKFNWYVDGVEVHNAKTK PREEQYASTYRVVSVLTVLHQDWLNGKEYKCKVSNKALPAPI EKTISKAKGQPREPQVYTLPPCREEMTKNQVSLWCLVKGFYPS DIAVEWESNGQPENNYKTTPPVLDSDGSFFLYSKLTVDKSRWQ QGNVFSCSVMHEALHNHYTQKSLSLSPGK |
| SEQ ID NO: 7439 | Anti-TRBC2 LC | DVVMTQSPLSLPVTPGEPASISCRSSQNLVHSNGRTYLQWYLQ KPGQSPQLLIYRVSNRFPGVPDRFSGSGSGTDFTLKISRVEAED VGVYFCSQSTHVPYTFGGGTKVEIKRTVAAPSVFIFPPSDEQLK SGTASVVCLLNNFYPREAKVQWKVDNALQSGNSQESVTEQDS KDSTYSLSSTLTLSKADYEKHKVYACEVTHQGLSSPVTKSFNR GEC |
| SEQ ID NO: 7383 | anti-NKp30 humanized 15E1 scFv-Fc | EIQLLESGGGLVQPGGSLRLSCAVSGFSITTTGYHWNWVRQAP GKGLEWVGYIYSSGSTSYNPSLKSRFTISRDTSKNTFYLQMNSL RAEDTAVYYCARGDWHYFDYWGQGTMVTVSSGGGGSGGGG SGGGGSGGGGSDSVTTQSPLSLPVTLGQPASISCSGEKLSDKYV HWYQQRPGQSPRMLIYENDRRPSGVPDRFSGSNSGNDATLKIS RVEAEDVGVYFCQFWDSTNSAVFGGGTKVEIKDKTHTCPPCP APELLGGPSVFLFPPKPKDTLMISRTPEVTCVVVDVSHEDPEVK FNWYVDGVEVHNAKTKPREEQYASTYRVVSVLTVLHQDWLN GKEYKCKVSNKALPAPIEKTISKAKGQPREPQVCTLPPSREEMT KNQVSLSCAVKGFYPSDIAVEWESNGQPENNYKTTPPVLDSDG SFFLVSKLTVDKSRWQQGNVFSCSVMHEALHNHYTQKSLSLSP GK |
| anti-TRBC2-NKp30 - BIS-2020-1 | | |
| SEQ ID NO: 8001 | Anti-TRBC2 - BKM0238-HC 1 | QVQLVQSGAEVKKPGSSVKVSCKASPRGFYGYHMHWVRQAP GQGLEWMGFINPYTNDIQYNERFRGRVTITSDESTTTAYMELSS LRSEDTAVYYCAMGNGKWGDGAYRFFDLWGQGTLVTVSSAS TKGPSVFPLAPSSKSTSGGTAALGCLVKDYFPEPVTVSWNSGA LTSGVHTFPAVLQSSGLYSLSSVVTVPSSSLGTQTYICNVNHKP SNTKVDKRVEPKSCDKTHTCPPCPAPELLGGPSVFLFPPKPKDT LMISRTPEVTCVVVDVSHEDPEVKFNWYVDGVEVHNAKTKPR EEQYASTYRVVSVLTVLHQDWLNGKEYKCKVSNKALPAPIEK TISKAKGQPREPQVYTLPPCREEMTKNQVSLWCLVKGFYPSDI AVEWESNGQPENNYKTTPPVLDSDGSFFLYSKLTVDKSRWQQ GNVFSCSVMHEALHNHYTQKSLSLSPGK |
| SEQ ID NO: 8002 | Anti-TRBC2-BKM0238-LC | DVVMTQSPLSLPVTLGQPASISCRSSENLVHSNGRTYLQWYQQ RPGQSPRLLIYRVSNRFPGVPDRFSGSGSGTDFTLKISRVEAEDV GVYFCSQSSLEPYTFGGGTKVEIKRTVAAPSVFIFPPSDEQLKSG TASVVCLLNNFYPREAKVQWKVDNALQSGNSQESVTEQDSKD STYSLSSTLTLSKADYEKHKVYACEVTHQGLSSPVTKSFNRGE C |
| SEQ ID NO: 7383, 7384/ SEQ ID NO: 8003 | Nk-p30 scFv | EIQLLESGGGLVQPGGSLRLSCAVSGFSITTTGYHWNWVRQAP GKGLEWVGYIYSSGSTSYNPSLKSRFTISRDTSKNTFYLQMNSL RAEDTAVYYCARGDWHYFDYWGQGTMVTVSSGGGGSGGGG SGGGGSGGGGSDSVTTQSPLSLPVTLGQPASISCSGEKLSDKYV HWYQQRPGQSPRMLIYENDRRPSGVPDRFSGSNSGNDATLKIS RVEAEDVGVYFCQFWDSTNSAVFGGGTKVEIKDKTHTCPPCP APELLGGPSVFLFPPKPKDTLMISRTPEVTCVVVDVSHEDPEVK FNWYVDGVEVHNAKTKPREEQYASTYRVVSVLTVLHQDWLN |

TABLE 17-continued

Exemplary multispecific antibody molecules or parts thereof that bind to TRBC2 AND/OR NKp30

| SEQ ID NO | Description | Sequence |
|---|---|---|
| | | GKEYKCKVSNKALPAPIEKTISKAKGQPREPQVCTLPPSREEMT KNQVSLSCAVKGFYPSDIAVEWESNGQPENNYKTTPPVLDSDG SFFLVSKLTVDKSRWQQGNVFSCSVMHEALHNHYTQKSLSLSP GK |
| anti-TRBC2-NKp30 - BIS-2020-2 | | |
| SEQ ID NO: 8001 | Anti-TRBC2-BKM0238- HC 1 | QVQLVQSGAEVKKPGSSVKVSCKASPRGFYGYHMHWVRQAP GQGLEWMGFINPYTNDIQYNERFRGRVTITSDESTTTAYMELSS LRSEDTAVYYCAMGNGKWGDGAYRFFDLWGQGTLVTVSSAS TKGPSVFPLAPSSKSTSGGTAALGCLVKDYFPEPVTVSWNSGA LTSGVHTFPAVLQSSGLYSLSSVVTVPSSSLGTQTYICNVNHKP SNTKVDKRVEPKSCDKTHTCPPCPAPELLGGPSVFLFPPKPKDT LMISRTPEVTCVVVDVSHEDPEVKFNWYVDGVEVHNAKTKPR EEQYASTYRVVSVLTVLHQDWLNGKEYKCKVSNKALPAPIEK TISKAKGQPREPQVYTLPPCREEMTKNQVSLWCLVKGFYPSDI AVEWESNGQPENNYKTTPPVLDSDGSFFLYSKLTVDKSRWQQ GNVFSCSVMHEALHNHYTQKSLSLSPGK |
| SEQ ID NO: 8002 | Anti-TRBC2 - BKM0238-LC | DVVMTQSPLSLPVTLGQPASISCRSSENLVHSNGRTYLQWYQQ RPGQSPRLLIYRVSNRFPGVPDRFSGSGSGTDFTLKISRVEAEDV GVYFCSQSSLEPYTFGGGTKVEIKRTVAAPSVFIFPPSDEQLKSG TASVVCLLNNFYPREAKVQWKVDNALQSGNSQESVTEQDSKD STYSLSSTLTLSKADYEKHKVYACEVTHQGLSSPVTKSFNRGE C |
| SEQ ID NO: 7383/SEQ ID NO: 8003, 8006 | Nk-p30 scFv | EIQLLESGGGLVQPGGSLRLSCAVSGFSITTTGYHWNWVRQAP GKGLEWVGYIYSSGSTSYNPSLKSRFTISRDTSKNTFYLQMNSL RAEDTAVYYCARGDWHYFDYWGQGTMVTVSSGGGGSGGGG SGGGGSGGGGSDSVTTQSPLSLPVTLGQPASISCSGEKLSDKYV HWYQQRPGQSPRMLIYENDRRPSGVPDRFSGSNSGNDATLKIS RVEAEDVGVYFCQFWDSTNSAVFGGGTKVEIKDKTHTCPPCP APELLGGPSVFLFPPKPKDTLMISRTPEVTCVVVDVSHEDPEVK FNWYVDGVEVHNAKTKPREEQYASTYRVVSVLTVLHQDWLN GKEYKCKVSNKALPAPIEKTISKAKGQPREPQVCTLPPSREEMT KNQVSLSCAVKGFYPSDIAVEWESNGQPENNYKTTPPVLDSDG SFFLVSKLTVDKSRWQQGNVFSCSVMHEALHNHYTQKSLSLSP GK |
| anti-TRBC2-NKp30 - BIS-2020-3 | | |
| SEQ ID NO: 8004 | Anti-TRBC2 - BKM0240-HC | QVQLVQSGAEVKKPGSSVKVSCKASPRGFYGYHMHWVRQAP GQGLEWMGFINPYNNHIQYNERFRGRVTITSDESTTTAYMELS SLRSEDTAVYYCALGNGKWGDGAYRFFDFWGQGTLVTVSSAS TKGPSVFPLAPSSKSTSGGTAALGCLVKDYFPEPVTVSWNSGA LTSGVHTFPAVLQSSGLYSLSSVVTVPSSSLGTQTYICNVNHKP SNTKVDKRVEPKSCDKTHTCPPCPAPELLGGPSVFLFPPKPKDT LMISRTPEVTCVVVDVSHEDPEVKFNWYVDGVEVHNAKTKPR EEQYASTYRVVSVLTVLHQDWLNGKEYKCKVSNKALPAPIEK TISKAKGQPREPQVYTLPPCREEMTKNQVSLWCLVKGFYPSDI AVEWESNGQPENNYKTTPPVLDSDGSFFLYSKLTVDKSRWQQ GNVFSCSVMHEALHNHYTQKSLSLSPGK |
| SEQ ID NO: 8005 | Anti-TRBC2 -- BKM0240- LC | DVVMTQSPLSLPVTLGQPASISCRSSKNLVHSNGRTYLQWYQQ RPGQSPRLLIYRVSNRFPGVPDRFSGSGSGTDFTLKISRVEAEDV GVYFCSQSTREPYTFGGGTKVEIKRTVAAPSVFIFPPSDEQLKSG TASVVCLLNNFYPREAKVQWKVDNALQSGNSQESVTEQDSKD STYSLSSTLTLSKADYEKHKVYACEVTHQGLSSPVTKSFNRGE C |
| SEQ ID NO: 7383, 7384/ SEQ ID NO: 8003 | Nk-p30 scFv | EIQLLESGGGLVQPGGSLRLSCAVSGFSITTTGYHWNWVRQAP GKGLEWVGYIYSSGSTSYNPSLKSRFTISRDTSKNTFYLQMNSL RAEDTAVYYCARGDWHYFDYWGQGTMVTVSSGGGGSGGGG SGGGGSGGGGSDSVTTQSPLSLPVTLGQPASISCSGEKLSDKYV HWYQQRPGQSPRMLIYENDRRPSGVPDRFSGSNSGNDATLKIS RVEAEDVGVYFCQFWDSTNSAVFGGGTKVEIKDKTHTCPPCP APELLGGPSVFLFPPKPKDTLMISRTPEVTCVVVDVSHEDPEVK FNWYVDGVEVHNAKTKPREEQYASTYRVVSVLTVLHQDWLN GKEYKCKVSNKALPAPIEKTISKAKGQPREPQVCTLPPSREEMT KNQVSLSCAVKGFYPSDIAVEWESNGQPENNYKTTPPVLDSDG SFFLVSKLTVDKSRWQQGNVFSCSVMHEALHNHYTQKSLSLSP GK |
| anti-TRBC2-NKp30 - BIS-2020-4 | | |
| SEQ ID NO: 8004 | Anti-TRBC2-- BKM0240- HC | QVQLVQSGAEVKKPGSSVKVSCKASPRGFYGYHMHWVRQAP GQGLEWMGFINPYNNHIQYNERFRGRVTITSDESTTTAYMELS SLRSEDTAVYYCALGNGKWGDGAYRFFDFWGQGTLVTVSSAS TKGPSVFPLAPSSKSTSGGTAALGCLVKDYFPEPVTVSWNSGA |

TABLE 17-continued

| Exemplary multispecific antibody molecules or parts thereof that bind to TRBC2 AND/OR NKp30 | | |
|---|---|---|
| SEQ ID NO | Description | Sequence |
| | | LTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK |
| SEQ ID NO: 8005 | Anti-TRBC2-BKM0240- LC | DVVMTQSPLSLPVTLGQPASISCRSSKNLVHSNGRTYLQWYQQRPGQSPRLLIYRVSNRFPGVPDRFSGSGSGTDFTLKISRVEAEDVGVYFCSQSTREPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| SEQ ID NO: 7383/SEQ ID NO: 8003, 8006 | Nk-p30 scFv | EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSSGGGGSGGGGSGGGGSGGGGSDSVTTQSPLSLPVTLGQPASISCSGEKLSDKYVHWYQQRPGQSPRMLIYENDRRPSGVPDRFSGSNSGNDATLKISRVEAEDVGVYFCQFWDSTNSAVFGGGTKVEIKDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK |
| anti-TRBC2-NKp30 - BIS-2020-5 | | |
| SEQ ID NO: 8007 | Anti-TRBC2-0311-HC | QVQLVQSGAEVKKPGSSVKVSCKASPRGFYGYHMHWVRQAPGQGLEWMGFINPYNNHIQYNERFRGRVTITSDESTTTAYMELSSLRSEDTAVYYCALGEGKWGDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK |
| SEQ ID NO: 8008 | Anti-TRBC2-0311-LC | DVVMTQSPLSLPVTLGQPASISCRSSKNLVHSNGRTYLQWYQQRPGQSPRLLIYRVSNRFPGVPDRFSGSGSGTDFTLKISRVEAEDVGVYFCSQSTREPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| SEQ ID NO: 7384 /SEQ ID NO: 8006 | Nk-p30 scFv | EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSSGGGGSGGGGSGGGGSGGGGSSSETTQPPSVSVSPGQTASITCSGEKLSDKYVHWYQQKPGQSPVMVIYENDRRPSGIPERFSGSNSGNTATLTISGTQAMDEADYFCQFWDSTNSAVFGGGTQLTVLDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK |
| anti-TRBC2-NKp30 - BIS-2020-6 | | |
| SEQ ID NO: 8007 | Anti-TRBC2-0311-HC | QVQLVQSGAEVKKPGSSVKVSCKASPRGFYGYHMHWVRQAPGQGLEWMGFINPYNNHIQYNERFRGRVTITSDESTTTAYMELSSLRSEDTAVYYCALGEGKWGDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK |
| SEQ ID NO: 8008 | Anti-TRBC2-0311-LC | DVVMTQSPLSLPVTLGQPASISCRSSKNLVHSNGRTYLQWYQQRPGQSPRLLIYRVSNRFPGVPDRFSGSGSGTDFTLKISRVEAEDVGVYFCSQSTREPYTFGGGTKVEIKRTVAAPSVFIFPPSDEQLKSGTASVVCLLNNFYPREAKVQWKVDNALQSGNSQESVTEQDSKD |

TABLE 17-continued

Exemplary multispecific antibody molecules or parts thereof that bind to TRBC2 AND/OR NKp30

| SEQ ID NO | Description | Sequence |
|---|---|---|
| | | STYSLSSTLTLSKADYEKHKVYACEVTHQGLSSPVTKSFNRGE C |
| SEQ ID NO: 7383/SEQ ID NO: 8003, 8006 | Nk-p30 scFv | EIQLLESGGGLVQPGGSLRLSCAVSGFSITTTGYHWNWVRQAP GKGLEWVGYIYSSGSTSYNPSLKSRFTISRDTSKNTFYLQMNSL RAEDTAVYYCARGDWHYFDYWGQGTMVTVSSGGGGSGGGG SGGGGSGGGGSDSVTTQSPLSLPVTLGQPASISCSGEKLSDKYV HWYQQRPGQSPRMLIYENDRRPSGVPDRFSGSNSGNDATLKIS RVEAEDVGVYFCQFWDSTNSAVFGGGTKVEIKDKTHTCPPCP APELLGGPSVFLFPPKPKDTLMISRTPEVTCVVVDVSHEDPEVK FNWYVDGVEVHNAKTKPREEQYASTYRVVSVLTVLHQDWLN GKEYKCKVSNKALPAPIEKTISKAKGQPREPQVCTLPPSREEMT KNQVSLSCAVKGFYPSDIAVEWESNGQPENNYKTTPPVLDSDG SFFLVSKLTVDKSRWQQGNVFSCSVMHEALHNHYTQKSLSLSP GK |
| anti-TRBC2-NKp30 - BIS-2020-7 | | |
| SEQ ID NO: 8009 | Anti-TRBC2-0314- HC | QVQLVQSGAEVKKPGSSVKVSCKASPRGFYGYHMHWVRQAP GQGLEWMGFINPYNNHIQYNERFRGRVTITSDESTTTAYMELS SLRSEDTAVYYCALGAGKWGDGAYRFFDFWGQGTLVTVSSAS TKGPSVFPLAPSSKSTSGGTAALGCLVKDYFPEPVTVSWNSGA LTSGVHTFPAVLQSSGLYSLSSVVTVPSSSLGTQTYICNVNHKP SNTKVDKRVEPKSCDKTHTCPPCPAPELLGGPSVFLFPPKPKDT LMISRTPEVTCVVVDVSHEDPEVKFNWYVDGVEVHNAKTKPR EEQYASTYRVVSVLTVLHQDWLNGKEYKCKVSNKALPAPIEK TISKAKGQPREPQVYTLPPCREEMTKNQVSLWCLVKGFYPSDI AVEWESNGQPENNYKTTPPVLDSDGSFFLYSKLTVDKSRWQQ GNVFSCSVMHEALHNHYTQKSLSLSPGK |
| SEQ ID NO: 8010 | Anti-TRBC2-0314-LC | DVVMTQSPLSLPVTLGQPASISCRSSKNLVHSNGRTYLQWYQQ RPGQSPRLLIYRVSNRFPGVPDRFSGSGSGTDFTLKISRVEAEDV GVYFCSQSTREPYTFGGGTKVEIKRTVAAPSVFIFPPSDEQLKSG TASVVCLLNNFYPREAKVQWKVDNALQSGNSQESVTEQDSKD STYSLSSTLTLSKADYEKHKVYACEVTHQGLSSPVTKSFNRGE C |
| SEQ ID NO: 7384 /SEQ ID NO: 8006 | Nk-p30 scFv | EIQLLESGGGLVQPGGSLRLSCAVSGFSITTTGYHWNWVRQAP GKGLEWVGYIYSSGSTSYNPSLKSRFTISRDTSKNTFYLQMNSL RAEDTAVYYCARGDWHYFDYWGQGTMVTVSSGGGGSGGGG SGGGGSGGGGSSSETTQPPSVSVSPGQTASITCSGEKLSDKYVH WYQQKPGQSPVMVIYENDRRPSGIPERFSGSNSGNTATLTISGT QAMDEADYFCQFWDSTNSAVFGGGTQLTVLDKTHTCPPCPAP ELLGGPSVFLFPPKPKDTLMISRTPEVTCVVVDVSHEDPEVKFN WYVDGVEVHNAKTKPREEQYASTYRVVSVLTVLHQDWLNGK EYKCKVSNKALPAPIEKTISKAKGQPREPQVCTLPPSREEMTKN QVSLSCAVKGFYPSDIAVEWESNGQPENNYKTTPPVLDSDGSF FLVSKLTVDKSRWQQGNVFSCSVMHEALHNHYTQKSLSLSPG K |
| anti-TRBC2-NKp30 - BIS-2020-8 | | |
| SEQ ID NO: 8009 | Anti-TRBC2-0314- HC | QVQLVQSGAEVKKPGSSVKVSCKASPRGFYGYHMHWVRQAP GQGLEWMGFINPYNNHIQYNERFRGRVTITSDESTTTAYMELS SLRSEDTAVYYCALGAGKWGDGAYRFFDFWGQGTLVTVSSAS TKGPSVFPLAPSSKSTSGGTAALGCLVKDYFPEPVTVSWNSGA LTSGVHTFPAVLQSSGLYSLSSVVTVPSSSLGTQTYICNVNHKP SNTKVDKRVEPKSCDKTHTCPPCPAPELLGGPSVFLFPPKPKDT LMISRTPEVTCVVVDVSHEDPEVKFNWYVDGVEVHNAKTKPR EEQYASTYRVVSVLTVLHQDWLNGKEYKCKVSNKALPAPIEK TISKAKGQPREPQVYTLPPCREEMTKNQVSLWCLVKGFYPSDI AVEWESNGQPENNYKTTPPVLDSDGSFFLYSKLTVDKSRWQQ GNVFSCSVMHEALHNHYTQKSLSLSPGK |
| SEQ ID NO: 8010 | Anti-TRBC2-0314- LC | DVVMTQSPLSLPVTLGQPASISCRSSKNLVHSNGRTYLQWYQQ RPGQSPRLLIYRVSNRFPGVPDRFSGSGSGTDFTLKISRVEAEDV GVYFCSQSTREPYTFGGGTKVEIKRTVAAPSVFIFPPSDEQLKSG TASVVCLLNNFYPREAKVQWKVDNALQSGNSQESVTEQDSKD STYSLSSTLTLSKADYEKHKVYACEVTHQGLSSPVTKSFNRGE C |
| SEQ ID NO: 7383/SEQ ID NO: 8003, 8006 | Nk-p30 scFv | EIQLLESGGGLVQPGGSLRLSCAVSGFSITTTGYHWNWVRQAP GKGLEWVGYIYSSGSTSYNPSLKSRFTISRDTSKNTFYLQMNSL RAEDTAVYYCARGDWHYFDYWGQGTMVTVSSGGGGSGGGG SGGGGSGGGGSDSVTTQSPLSLPVTLGQPASISCSGEKLSDKYV HWYQQRPGQSPRMLIYENDRRPSGVPDRFSGSNSGNDATLKIS RVEAEDVGVYFCQFWDSTNSAVFGGGTKVEIKDKTHTCPPCP APELLGGPSVFLFPPKPKDTLMISRTPEVTCVVVDVSHEDPEVK FNWYVDGVEVHNAKTKPREEQYASTYRVVSVLTVLHQDWLN GKEYKCKVSNKALPAPIEKTISKAKGQPREPQVCTLPPSREEMT |

TABLE 17-continued

| Exemplary multispecific antibody molecules or parts thereof that bind to TRBC2 AND/OR NKp30 | | |
|---|---|---|
| SEQ ID NO | Description | Sequence |
| | | KNQVSLSCAVKGFYPSDIAVEWESNGQPENNYKTTPPVLDSDG SFFLVSKLTVDKSRWQQGNVFSCSVMHEALHNHYTQKSLSLSP GK |

Multifunctional Antibody Effector Function and Fc Variants

In some embodiments, the multifunctional molecule (e.g., an anti-TRBC1/NKp30 antibody molecule or an anti-TRBC2/NKp30 antibody molecule) disclosed herein comprises an Fc region, e.g., as described herein. In some embodiments, the Fc region is a wildtype Fc region, e.g., a wildtype human Fc region. In some embodiments, the Fc region comprises a variant, e.g., an Fc region comprising an addition, substitution, or deletion of at least one amino acid residue in the Fc region which results in, e.g., reduced or ablated affinity for at least one Fc receptor.

The Fc region of an antibody interacts with a number of receptors or ligands including Fc Receptors (e.g., FcγRI, FcγRIIA, FcγRIIIA), the complement protein CIq, and other molecules such as proteins A and G. These interactions are essential for a variety of effector functions and downstream signaling events including: antibody dependent cell-mediated cytotoxicity (ADCC), Antibody-dependent cellular phagocytosis (ADCP) and complement dependent cytotoxicity (CDC).

In some embodiments, the multifunctional molecule (e.g., an anti-TRBC1/NKp30 antibody molecule or an anti-TRBC2/NKp30 antibody molecule) comprising a variant Fc region has reduced, e.g., ablated, affinity for an Fc receptor, e.g., an Fc receptor described herein. In some embodiments, the reduced affinity is compared to an otherwise similar antibody with a wildtype Fc region.

In some embodiments, the multifunctional molecule (e.g., an anti-TRBC1/NKp30 antibody molecule or an anti-TRBC2/NKp30 antibody molecule) comprising a variant Fc region has one or more of the following properties: (1) reduced effector function (e.g., reduced ADCC, ADCP and/or CDC); (2) reduced binding to one or more Fc receptors; and/or (3) reduced binding to C1q complement. In some embodiments, the reduction in any one, or all of properties (1)-(3) is compared to an otherwise similar antibody with a wildtype Fc region.

In some embodiments, the multifunctional molecule (e.g., an anti-TRBC1/NKp30 antibody molecule or an anti-TRBC2/NKp30 antibody molecule) comprising a variant Fc region has reduced affinity to a human Fc receptor, e.g., FcγR I, FcγR II and/or FcγR III. In some embodiments, the multifunctional molecule (e.g., an anti-TRBC1/NKp30 antibody molecule or an anti-TRBC2/NKp30 antibody molecule) comprising a variant Fc region comprises a human IgG1 region or a human IgG4 region.

Exemplary Fc region variants are provided in Table 18 and also disclosed in Saunders O, (2019) *Frontiers in Immunology*; vol 10, article 1296, the entire contents of which is hereby incorporated by reference.

In some embodiments, the multifunctional molecule (e.g., an anti-TRBC1/NKp30 antibody molecule or an anti-TRBC2/NKp30 antibody molecule) comprises any one or all, or any combination of Fc region variants, e.g., mutations, disclosed in Table 18. In some embodiments, the multifunctional molecule (e.g., an anti-TRBC1/NKp30 antibody molecule or an anti-TRBC2/NKp30 antibody molecule) comprises an Asn297Ala (N297A) mutation. In some embodiments, the multifunctional molecule (e.g., an anti-TRBC1/NKp30 antibody molecule or an anti-TRBC2/NKp30 antibody molecule) comprises a Leu234Ala/Leu235Ala (LALA) mutation.

TABLE 18

| Exemplary Fc modifications | |
|---|---|
| Modification or mutation | Altered effector function |
| Leu235Glu | ADCC; |
| Leu234Ala/Leu235Ala (LALA) | ADCC; ADCP; CDC |
| Ser228Pro/Leu235Glu | |
| Leu234Ala/Leu235Ala/Pro329Gly | ADCP |
| Pro331Ser/Leu234Glu/Leu235Phe | CDC |
| Asp265Ala | ADCC, ADCP |
| Gly237Ala | ADCP |
| Glu318Ala | ADCP |
| Glu233Pro | |
| Gly236Arg/Leu328Arg | ADCC |
| His268Gln/Val309Leu/Ala330Ser/Pro331Ser | ADCC; ADCP; CDC |
| Val234Ala/Gly237Ala/Pro238Ser/ His268Ala/Val309Leu/Ala330Ser/Pro331Ser | ADCC; ADCP; CDC |
| Leu234Ala/L235Ala/Gly237Ala/P238Ser/His268Ala/Ala330Ser/Pro331Ser | ADCC; CDC |
| Ala330Leu | CDC |
| Asp270Ala | CDC |
| Lys322Ala | CDC |
| Pro329Ala | CDC |
| Pro331Ala | CDC |
| Val264Ala | CDC |
| High mannose glycosylation | CDC |
| Phe241Ala | CDC |

TABLE 18-continued

| Exemplary Fc modifications | |
|---|---|
| Modification or mutation | Altered effector function |
| Asn297Ala or Gly or Gln | ADCC; ADCP; CDC |
| S228P/Phe234Ala/Leu235Ala | ADCC; CDC |

Antibody Molecules Targeting TRBC1

In another aspect, the present disclosure features an antibody molecule, e.g., a monoclonal antibody molecule, or fragment thereof that binds TRBC 1.

In some embodiments, the antibody molecule, or fragment thereof, that binds to TRBC 1 comprises one or more CDRs (e.g., VHCDR1, VHCDR2, VHCDR3, VLCDR1, VLCDR2, and/or VLCDR3) disclosed in Table 2A or Table 2B, Table 3A or Table 3B, or Table 4, or a sequence having at least 85%, 90%, 95%, or 99% identity thereto. In some embodiments, the antibody molecule, or fragment thereof, that binds to TRBC1 comprises one or more framework regions (e.g., VHFWR1, VHFWR2, VHFWR3, VHFWR4, VLFWR1, VLFWR2, VLFWR3, and/or VLFWR4) disclosed in Table 2A or Table 2B, Table 3A or Table 3B, or Table 4, or a sequence having at least 85%, 90%, 95%, or 99% identity thereto. In some embodiments, the antibody molecule, or fragment thereof, that binds to TRBC1 comprises a VH and/or a VL disclosed in Table 7, or a sequence having at least 85%, 90%, 95%, or 99% identity thereto. In some embodiments, the antibody molecule, or fragment thereof, that binds to TRBC1 comprises an amino acid sequence disclosed in Table 8, or a sequence having at least 85%, 90%, 95%, or 99% identity thereto.

In some embodiments, the antibody molecule, or fragment thereof, that binds to TRBC1 comprises a VH comprising a heavy chain complementarity determining region 1 (VHCDR1), a VHCDR2, and a VHCDR3, and a VL comprising a light chain complementarity determining region 1 (VLCDR1), a VLCDR2, and a VLCDR3.

In some embodiments, the VHCDR1, VHCDR2, and VHCDR3 comprise the amino acid sequences of SEQ ID NOs: 7346, 7355, and 202, respectively (or a sequence having at least 85%, 90%, 95%, or 99% identity thereto). In some embodiments, the VHCDR1, VHCDR2, and VHCDR3 comprise the amino acid sequences of SEQ ID NOs: 7346, 201, and 202, respectively (or a sequence having at least 85%, 90%, 95%, or 99% identity thereto). In some embodiments, the VHCDR1, VHCDR2, and VHCDR3 comprise the amino acid sequences of SEQ ID NOs: 7354, 201, and 202, respectively (or a sequence having at least 85%, 90%, 95%, or 99% identity thereto). In some embodiments, the VHCDR1, VHCDR2, and VHCDR3 comprise the amino acid sequences of SEQ ID NOs: 7354, 7355, and 202, respectively (or a sequence having at least 85%, 90%, 95%, or 99% identity thereto).

In some embodiments, the VLCDR1, VLCDR2, and VLCDR3 comprise the amino acid sequences of SEQ ID NOs: 223, 224, and 225, respectively (or a sequence having at least 85%, 90%, 95%, or 99% identity thereto). In some embodiments, the VLCDR1, VLCDR2, and VLCDR3 comprise the amino acid sequences of SEQ ID NOs: 7367, 224, and 225, respectively (or a sequence having at least 85%, 90%, 95%, or 99% identity thereto). In some embodiments, the VLCDR1, VLCDR2, and VLCDR3 comprise the amino acid sequences of SEQ ID NOs: 223, 7368, and 225, respectively (or a sequence having at least 85%, 90%, 95%, or 99% identity thereto). In some embodiments, the VLCDR1, VLCDR2, and VLCDR3 comprise the amino acid sequences of SEQ ID NOs: 223, 224, and 7369, respectively (or a sequence having at least 85%, 90%, 95%, or 99% identity thereto). In some embodiments, the VLCDR1, VLCDR2, and VLCDR3 comprise the amino acid sequences of SEQ ID NOs: 7367, 7368, and 7369, respectively (or a sequence having at least 85%, 90%, 95%, or 99% identity thereto).

In some embodiments, the VHCDR1, VHCDR2, VHCDR3, VLCDR1, VLCDR2, and VLCDR3 comprise the amino acid sequences of SEQ ID NOs: 7346, 7355, 202, 223, 224, and 225, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 7346, 201, 202, 223, 224, and 225, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of: SEQ ID NOs: 7346, 7355, 202, 7367, 224, and 225, respectively (or a sequence having at least 85%, 90%, 95%, or 99% identity thereto); SEQ ID NOs: 7346, 7355, 202, 223, 7368, and 225, respectively (or a sequence having at least 85%, 90%, 95%, or 99% identity thereto); SEQ ID NOs: 7346, 7355, 202, 223, 224, and 7369, respectively (or a sequence having at least 85%, 90%, 95%, or 99% identity thereto); SEQ ID NOs: 7346, 7355, 202, 7367, 7368, and 7369, respectively (or a sequence having at least 85%, 90%, 95%, or 99% identity thereto); SEQ ID NOs: 7346, 201, 202, 7367, 224, and 225, respectively (or a sequence having at least 85%, 90%, 95%, or 99% identity thereto); SEQ ID NOs: 7346, 201, 202, 223, 7368, and 225, respectively (or a sequence having at least 85%, 90%, 95%, or 99% identity thereto); SEQ ID NOs: 7346, 201, 202, 223, 224, and 7369, respectively (or a sequence having at least 85%, 90%, 95%, or 99% identity thereto); SEQ ID NOs: 7346, 201, 202, 7367, 7368, and 7369, respectively (or a sequence having at least 85%, 90%, 95%, or 99% identity thereto); SEQ ID NOs: 7354, 201, 202, 223, 224, and 225, respectively (or a sequence having at least 85%, 90%, 95%, or 99% identity thereto); SEQ ID NOs: 7354, 201, 202, 7367, 224, and 225, respectively (or a sequence having at least 85%, 90%, 95%, or 99% identity thereto); SEQ ID NOs: 7354, 201, 202, 223, 7368, and 225, respectively (or a sequence having at least 85%, 90%, 95%, or 99% identity thereto); SEQ ID NOs: 7354, 201, 202, 223, 224, and 7369, respectively (or a sequence having at least 85%, 90%, 95%, or 99% identity thereto); SEQ ID NOs: 7354, 201, 202, 7367, 7368, and 7369, respectively (or a sequence having at least 85%, 90%, 95%, or 99% identity thereto); SEQ ID NOs: 7354, 7355, 202, 223, 224, and 225, respectively (or a sequence having at least 85%, 90%, 95%, or 99% identity thereto); SEQ ID NOs: 7354, 7355, 202, 7367, 224, and 225, respectively (or a sequence having at least 85%, 90%, 95%, or 99% identity thereto); SEQ ID NOs: 7354, 7355, 202, 223, 7368, and 225, respectively (or a sequence having at least 85%, 90%, 95%, or 99% identity thereto); SEQ ID NOs: 7354, 7355, 202, 223, 224, and 7369, respectively (or a sequence having at least 85%, 90%, 95%, or 99% identity thereto); or SEQ ID NOs: 7354, 7355, 202, 7367, 7368, and 7369, respectively (or a sequence having at least 85%, 90%, 95%, or 99% identity thereto).

In some embodiments, the VH comprises an amino acid sequence selected from the group consisting of SEQ ID NOs: 7351, 253, 250-252, 254, 7343, 7344, 7350, and 7352 (or a sequence having at least 85%, 90%, 95%, or 99% identity thereto) and/or the VL comprises an amino acid sequence selected from the group consisting of SEQ ID NOs: 258, 255-257, 259, 260, and 7357-7360 (or a sequence having at least 85%, 90%, 95%, or 99% identity thereto). In some embodiments, the VH and VL comprise the amino acid sequences of SEQ ID NOs: 7351 and 258, respectively (or a sequence having at least 85%, 90%, 95%, or 99% identity thereto). In some embodiments, the VH and VL comprise the amino acid sequences of SEQ ID NOs: 253 and 258, respectively (or a sequence having at least 85%, 90%, 95%, or 99% identity thereto).

In some embodiments, the antibody molecule or fragment thereof comprises:

a heavy chain variable region (VH) comprising a heavy chain framework region 1 (VHFWR1) amino acid sequence of SEQ ID NO: 215 (or a sequence with no more than 1, 2, 3, 4, 5, or 6 mutations, e.g., substitutions, additions, or deletions, therefrom), a VHFWR2 amino acid sequence of SEQ ID NO: 216 (or a sequence with no more than 1, 2, 3, 4, 5, or 6 mutations, e.g., substitutions, additions, or deletions, therefrom), a VHFWR3 amino acid sequence of SEQ ID NO: 217 (or a sequence with no more than 1, 2, 3, 4, 5, or 6 mutations, e.g., substitutions, additions, or deletions, therefrom), and/or a VHFWR4 amino acid sequence of SEQ ID NO: 218 (or a sequence with no more than 1, 2, 3, 4, 5, or 6 mutations, e.g., substitutions, additions, or deletions, therefrom), and a light chain variable region (VL) comprising a light chain framework region 1 (VLFWR1) amino acid sequence of SEQ ID NO: 238 (or a sequence with no more than 1, 2, 3, 4, 5, or 6 mutations, e.g., substitutions, additions, or deletions, therefrom), a VLFWR2 amino acid sequence of SEQ ID NO: 239 (or a sequence with no more than 1, 2, 3, 4, 5, or 6 mutations, e.g., substitutions, additions, or deletions, therefrom), a VLFWR3 amino acid sequence of SEQ ID NO: 240 (or a sequence with no more than 1, 2, 3, 4, 5, or 6 mutations, e.g., substitutions, additions, or deletions, therefrom), and/or a VLFWR4 amino acid sequence of SEQ ID NO: 241 (or a sequence with no more than 1, 2, 3, 4, 5, or 6 mutations, e.g., substitutions, additions, or deletions, therefrom).

In some embodiments, the antibody molecule or fragment thereof comprises a VH comprising a VHCDR1 amino acid sequence of SEQ ID NO: 200, a VHCDR2 amino acid sequence of SEQ ID NO: 201, and/or a VHCDR3 amino acid sequence of SEQ ID NO: 202.

In some embodiments, the antibody molecule or fragment thereof comprises a VL comprising a VLCDR1 amino acid sequence of SEQ ID NO: 223, a VLCDR2 amino acid sequence of SEQ ID NO: 224, and a VLCDR3 amino acid sequence of SEQ ID NO: 225.

In some embodiments, the antibody molecule or fragment thereof comprises a VH comprising the amino acid sequence of SEQ ID NO: 253 (or an amino acid sequence having at least about 75%, 80%, 85%, 90%, 95%, or 99% sequence identity thereto), and/or a VL comprising the amino acid sequence of SEQ ID NO: 258 (or an amino acid sequence having at least about 93%, 95%, or 99% sequence identity thereto). In some embodiments, the antibody molecule or fragment thereof comprises a VH and/or VL substantially homologous to SEQ ID NOs: 253 and/or 258.

Antibody Molecules Targeting TRBC2

In another aspect, the present disclosure features an antibody molecule, e.g., a monoclonal antibody molecule, or fragment thereof that binds TRBC2.

In some embodiments, the antibody molecule, or fragment thereof, that binds to TRBC2 comprises one or more CDRs (e.g., VHCDR1, VHCDR2, VHCDR3, VLCDR1, VLCDR2, and/or VLCDR3) disclosed in Table 9 or Table 10, or a sequence having at least 85%, 90%, 95%, or 99% identity thereto. In some embodiments, the antibody molecule, or fragment thereof, that binds to TRBC2 comprises one or more framework regions (e.g., VHFWR1, VHFWR2, VHFWR3, VHFWR4, VLFWR1, VLFWR2, VLFWR3, and/or VLFWR4) disclosed in Table 9 or Table 10, or a sequence having at least 85%, 90%, 95%, or 99% identity thereto. In some embodiments, the antibody molecule, or fragment thereof, that binds to TRBC2 comprises a VH and/or a VL disclosed in Table 11, or a sequence having at least 85%, 90%, 95%, or 99% identity thereto. In some embodiments, the antibody molecule, or fragment thereof, that binds to TRBC2 comprises an amino acid sequence disclosed in Table 12, or a sequence having at least 85%, 90%, 95%, or 99% identity thereto.

In some embodiments, the antibody molecule, or fragment thereof, that binds to TRBC2 comprises a VH comprising a heavy chain complementarity determining region 1 (VHCDR1), a VHCDR2, and a VHCDR3, and a VL comprising a light chain complementarity determining region 1 (VLCDR1), a VLCDR2, and a VLCDR3.

In some embodiments, the VHCDR1, VHCDR2, and VHCDR3 comprise the amino acid sequences of SEQ ID NOs: 7441, 201, and 7442, respectively (or a sequence having at least 85%, 90%, 95%, or 99% identity thereto). In some embodiments, the VHCDR1, VHCDR2, and VHCDR3 comprise the amino acid sequences of SEQ ID NOs: 7422, 201, and 7403, respectively (or a sequence having at least 85%, 90%, 95%, or 99% identity thereto). In some embodiments, the VHCDR1, VHCDR2, and VHCDR3 comprise the amino acid sequences of SEQ ID NOs: 7401, 201, and 7403, respectively (or a sequence having at least 85%, 90%, 95%, or 99% identity thereto). In some embodiments, the VHCDR1, VHCDR2, and VHCDR3 comprise the amino acid sequences of SEQ ID NOs: 7394, 201, and 7396, respectively (or a sequence having at least 85%, 90%, 95%, or 99% identity thereto). In some embodiments, the VHCDR1, VHCDR2, and VHCDR3 comprise the amino acid sequences of SEQ ID NOs: 7346, 201, and 7398, respectively (or a sequence having at least 85%, 90%, 95%, or 99% identity thereto). In some embodiments, the VHCDR1, VHCDR2, and VHCDR3 comprise the amino acid sequences of SEQ ID NOs: 7346, 201, and 7400, respectively (or a sequence having at least 85%, 90%, 95%, or 99% identity thereto). In some embodiments, the VHCDR1, VHCDR2, and VHCDR3 comprise the amino acid sequences of SEQ ID NOs: 7405, 201, and 7403, respectively (or a sequence having at least 85%, 90%, 95%, or 99% identity thereto). In some embodiments, the VHCDR1, VHCDR2, and VHCDR3 comprise the amino acid sequences of SEQ ID NOs: 7407, 201, and 7403, respectively (or a sequence having at least 85%, 90%, 95%, or 99% identity thereto). In some embodiments, the VHCDR1, VHCDR2, and VHCDR3 comprise the amino acid sequences of SEQ ID NOs: 7427, 201, and 7403, respectively (or a sequence having at least 85%, 90%, 95%, or 99% identity thereto). In some embodiments, the VHCDR1, VHCDR2, and VHCDR3 comprise the amino acid sequences of SEQ ID NOs: 7430, 201, and 7403, respectively (or a sequence having at least 85%, 90%, 95%, or 99% identity thereto).

In some embodiments, the VLCDR1, VLCDR2, and VLCDR3 comprise the amino acid sequences of SEQ ID NOs: 7443, 224, and 225, respectively (or a sequence having at least 85%, 90%, 95%, or 99% identity thereto). In some embodiments, the VLCDR1, VLCDR2, and VLCDR3 comprise the amino acid sequences of SEQ ID NOs: 7410, 224, and 225, respectively (or a sequence having at least 85%, 90%, 95%, or 99% identity thereto). In some embodiments, the VLCDR1, VLCDR2, and VLCDR3 comprise the amino acid sequences of SEQ ID NOs: 7409, 224, and 225, respectively (or a sequence having at least 85%, 90%, 95%, or 99% identity thereto).

In some embodiments, the VHCDR1, VHCDR2, VHCDR3, VLCDR1, VLCDR2, and VLCDR3 comprise the amino acid sequences of SEQ ID NOs: 7441, 201, 7442, 7443, 224, and 225, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 7422, 201, 7403, 7410, 224, and 225, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 7401, 201, 7403, 7410, 224, and 225, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of: SEQ ID NOs: 7394, 201, 7396, 7410, 224, and 225, respectively (or a sequence having at least 85%, 90%, 95%, or 99% identity thereto); SEQ ID NOs: 7346, 201, 7398, 7410, 224, and 225, respectively (or a sequence having at least 85%, 90%, 95%, or 99% identity thereto); SEQ ID NOs: 7346, 201, 7400, 7410, 224, and 225, respectively (or a sequence having at least 85%, 90%, 95%, or 99% identity thereto); SEQ ID NOs: 7405, 201, 7403, 7410, 224, and 225, respectively (or a sequence having at least 85%, 90%, 95%, or 99% identity thereto); SEQ ID NOs: 7407, 201, 7403, 7410, 224, and 225, respectively (or a sequence having at least 85%, 90%, 95%, or 99% identity thereto); SEQ ID NOs: 7427, 201, 7403, 7410, 224, and 225, respectively (or a sequence having at least 85%, 90%, 95%, or 99% identity thereto); SEQ ID NOs: 7430, 201, 7403, 7410, 224, and 225, respectively (or a sequence having at least 85%, 90%, 95%, or 99% identity thereto); SEQ ID NOs: 7422, 201, 7403, 7409, 224, and 225, respectively (or a sequence having at least 85%, 90%, 95%, or 99% identity thereto); SEQ ID NOs: 7401, 201, 7403, 7409, 224, and 225, respectively (or a sequence having at least 85%, 90%, 95%, or 99% identity thereto); SEQ ID NOs: 7394, 201, 7396, 7409, 224, and 225, respectively (or a sequence having at least 85%, 90%, 95%, or 99% identity thereto); SEQ ID NOs: 7346, 201, 7398, 7409, 224, and 225, respectively (or a sequence having at least 85%, 90%, 95%, or 99% identity thereto); SEQ ID NOs: 7346, 201, 7400, 7409, 224, and 225, respectively (or a sequence having at least 85%, 90%, 95%, or 99% identity thereto); SEQ ID NOs: 7405, 201, 7403, 7409, 224, and 225, respectively (or a sequence having at least 85%, 90%, 95%, or 99% identity thereto); SEQ ID NOs: 7407, 201, 7403, 7409, 224, and 225, respectively (or a sequence having at least 85%, 90%, 95%, or 99% identity thereto); SEQ ID NOs: 7427, 201, 7403, 7409, 224, and 225, respectively (or a sequence having at least 85%, 90%, 95%, or 99% identity thereto); or SEQ ID NOs: 7430, 201, 7403, 7409, 224, and 225, respectively (or a sequence having at least 85%, 90%, 95%, or 99% identity thereto).

In some embodiments, the VH comprises an amino acid sequence selected from the group consisting of SEQ ID NOs: 7420, 7423, 7411, 7412, 7413, 7414, 7415, 7416, 7417, 7425, 7428, and 7431 (or a sequence having at least 85%, 90%, 95%, or 99% identity thereto) and/or the VL comprises an amino acid sequence selected from the group consisting of SEQ ID NOs: 7419 and 7418 (or a sequence having at least 85%, 90%, 95%, or 99% identity thereto). In some embodiments, the VH and VL comprise the amino acid sequences of SEQ ID NOs: 7420 and 7419, respectively (or a sequence having at least 85%, 90%, 95%, or 99% identity thereto). In some embodiments, the VH and VL comprise the amino acid sequences of SEQ ID NOs: 7423 and 7419, respectively (or a sequence having at least 85%, 90%, 95%, or 99% identity thereto). In some embodiments, the VH and VL comprise the amino acid sequences of SEQ ID NOs: 7411 and 7419, respectively (or a sequence having at least 85%, 90%, 95%, or 99% identity thereto). In some embodiments, the VH and VL comprise the amino acid sequences of SEQ ID NOs: 7412 and 7419, respectively (or a sequence having at least 85%, 90%, 95%, or 99% identity thereto). In some embodiments, the VH and VL comprise the amino acid sequences of SEQ ID NOs: 7413 and 7419, respectively (or a sequence having at least 85%, 90%, 95%, or 99% identity thereto). In some embodiments, the VH and VL comprise the amino acid sequences of SEQ ID NOs: 7414 and 7419, respectively (or a sequence having at least 85%, 90%, 95%, or 99% identity thereto). In some embodiments, the VH and VL comprise the amino acid sequences of SEQ ID NOs: 7415 and 7419, respectively (or a sequence having at least 85%, 90%, 95%, or 99% identity thereto). In some embodiments, the VH and VL comprise the amino acid sequences of SEQ ID NOs: 7416 and 7419, respectively (or a sequence having at least 85%, 90%, 95%, or 99% identity thereto). In some embodiments, the VH and VL comprise the amino acid sequences of SEQ ID NOs: 7417 and 7419, respectively (or a sequence having at least 85%, 90%, 95%, or 99% identity thereto). In some embodiments, the VH and VL comprise the amino acid sequences of SEQ ID NOs: 7425 and 7419, respectively (or a sequence having at least 85%, 90%, 95%, or 99% identity thereto). In some embodiments, the VH and VL comprise the amino acid sequences of SEQ ID NOs: 7428 and 7419, respectively (or a sequence having at least 85%, 90%, 95%, or 99% identity thereto). In some embodiments, the VH and VL comprise the amino acid sequences of SEQ ID NOs: 7431 and 7419, respectively (or a sequence having at least 85%, 90%, 95%, or 99% identity thereto). In some embodiments, the VH and VL comprise the amino acid sequences of SEQ ID NOs: 7420 and 7418, respectively (or a sequence having at least 85%, 90%, 95%, or 99% identity thereto). In some embodiments, the VH and VL comprise the amino acid sequences of SEQ ID NOs: 7423 and 7418, respectively (or a sequence having at least 85%, 90%, 95%, or 99% identity thereto). In some embodiments, the VH and VL comprise the amino acid sequences of SEQ ID NOs: 7411 and 7418, respectively (or a sequence having at least 85%, 90%, 95%, or 99% identity thereto). In some embodiments, the VH and VL comprise the amino acid sequences of SEQ ID NOs: 7412 and 7418, respectively (or a sequence having at least 85%, 90%, 95%, or 99% identity thereto). In some embodiments, the VH and VL comprise the amino acid sequences of SEQ ID NOs: 7413 and 7418, respectively (or a sequence having at least 85%, 90%, 95%, or 99% identity thereto). In some embodiments, the VH and VL comprise the amino acid sequences of SEQ ID NOs: 7414 and 7418, respectively (or a sequence having at least 85%, 90%, 95%, or 99% identity thereto). In some embodiments, the VH and VL comprise the amino acid sequences of SEQ ID NOs: 7415 and 7418, respectively (or a sequence having at least 85%, 90%, 95%, or 99% identity thereto). In some embodiments, the VH and VL comprise the amino acid sequences of SEQ ID NOs: 7416 and 7418, respectively (or a sequence having at least 85%, 90%, 95%, or 99% identity thereto). In some embodiments, the VH and VL comprise the amino acid sequences of SEQ ID NOs: 7417 and 7418, respectively (or a sequence having at least 85%, 90%, 95%, or 99% identity thereto). In some embodiments, the VH and VL comprise the amino acid sequences of SEQ ID NOs: 7425 and 7418, respectively (or a sequence having at least 85%, 90%, 95%, or 99% identity thereto). In some embodiments, the VH and VL comprise the amino acid sequences of SEQ ID NOs: 7428 and 7418, respectively (or a sequence having at least 85%, 90%, 95%, or 99% identity thereto). In some embodiments, the VH and VL comprise the amino acid sequences of SEQ ID NOs: 7431 and 7418, respectively (or a sequence having at least 85%, 90%, 95%, or 99% identity thereto).

In another aspect, the disclosure features an antibody molecule, e.g., an IgM antibody molecule comprising: (i) a first antigen binding domain that selectively binds to T cell receptor beta chain constant domain 1 (TRBC1) or T cell receptor beta chain constant domain 2 (TRBC2), and (ii) a complement activating domain that activates the complement pathway, e.g., by binding C1q. In some embodiments, an antibody molecule, e.g., IgM antibody molecule, comprises an antigen binding domain that targets TRBC1. In some embodiments, the antibody molecule is an IgM antibody molecule, e.g., that multimerizes into tetramers, pentamers, and/or hexamers and is capable of activating complement pathway(s). In some embodiments, the IgM antibody molecule comprises an antigen binding domain that targets TRBC1 comprising a heavy chain comprising the amino acid sequence of SEQ ID NO: 6173 (or an amino acid sequence having at least about 93%, 95%, or 99% sequence identity to SEQ ID NO: 6173).

(SEQ ID NO: 6173)
METDTLLLWVLLLWVPGSTGQVQLVQSGAEVKKPGSSVKVSCKASGYTFT
GYVMHWVRQAPGQGLEWMGFINPYNDDIQSNERFRGRVTITSDKSTTTAY
MELSSLRSEDTAVYYCARGAGYNFDGAYRFFDFWGQGTLVTVSSGSASAP
TLFPLVSCENSPSDTSSVAVGCLAQDFLPDSITFSWKYKNNSDISSTRGF
PSVLRGGKYAATSQVLLPSKDVMQGTDEHVVCKVQHPNGNKEKNVPLPVI
AELPPKVSVFVPPRDGFFGNPRKSKLICQATGFSPRQIQVSWLREGKQVG
SGVTTDQVQAEAKESGPTTYKVTSTLTIKESDWLGQSMFTCRVDHRGLTF
QQNASSMCVPDQDTAIRVFAIPPSFASIFLTKSTKLTCLVTDLTTYDSVT
ISWTRQNGEAVKTHTNISESHPNATFSAVGEASICEDDWNSGERFTCTVT
HTDLPSPLKQTISRPKGVALHRPDVYLLPPAREQLNLRESATITCLVTGF
SPADVFVQWMQRGQPLSPEKYVTSAPMPEPQAPGRYFAHSILTVSEEEWN
TGETYTCVVAHEALPNRVTERTVDKSTGKPTLYNVSLVMSDTAGTCY.

In some embodiments, the IgM antibody molecule comprises an antigen binding domain that targets TRBC1 comprising a light chain comprising the amino acid sequence of SEQ ID NO: 6174 (or an amino acid sequence having at least about 93%, 95%, or 99% sequence identity to SEQ ID NO: 6174).

(SEQ ID NO: 6174)
MKNHLLFWGVLAVFIKAVHVKAQEDERIVLVDNKCKCARITSRIIRSSED
PNEDIVERNIRIIVPLNNRENISDPTSPLRTRFVYHLSDLCKKCDPTEVE
LDNQIVTATQSNICDEDSATETCYTYDRNKCYTAVVPLVYGGETKMVETA
LTPDACYPD.

In some embodiments, the IgM antibody molecule comprises an antigen binding domain that targets TRBC1 comprising amino acid sequences of SEQ ID NO: 6173 and 6174 (or amino acid sequences having at least about 93%, 95%, or 99% sequence identity to SEQ ID NO: 6173 and 6174) and an amino acid sequence of a light chain sequence provided herein, e.g., in Table 4 or Table 7.

In some embodiments, the complement activating domain comprises a portion of an antibody molecule capable of binding or being bound by C1q, e.g., a portion of a IgG1, IgG2, IgG3, IgG4, IgM, IgA1, IgA2, IgD, or IgE. In some embodiments, a complement activating domain comprises a Ch2, Ch3, or Ch4 domain.

Without wishing to be bound by theory, it is thought that complement activation in proximity to a target cell (e.g., a TRBC1 or TRBC2 expressing cell, e.g., a lymphocyte expressing TRBC1 or TRBC2, e.g., a lymphoma cell expressing TRBC1 or TRBC2) may induce the death of the target cell. In some embodiments, use of an antibody molecule, e.g., IgM antibody molecule, or a multifunctional molecule in the methods described herein induces complement mediated cell death of the target cell.

In another aspect, the disclosure features a multispecific antibody molecule (e.g., a bispecific antibody molecule) that binds to TRBC1 and NKp30. In some embodiments, the multispecific antibody molecule comprises one or more moieties that bind to TRBC1, e.g., one or more Fabs that bind to TRBC1, e.g., one or two Fabs that bind to TRBC1. In some embodiments, the multispecific antibody molecule comprises one or more moieties that bind to NKp30, e.g., one or more scFvs that bind to NKp30, e.g., one or two scFvs that bind to NKp30. In some embodiments, the moiety that binds to TRBC1 comprises an anti-TRBC1 sequence disclosed herein, e.g., comprises a CDR, VH, VL, heavy chain, or light chain sequence disclosed in Table 1, Table 2A or Table 2B, Table 4, Table 7, Table 8, or a sequence having at least 70, 80, 90, 95, or 99% identity thereto. In some embodiments, the moiety that binds to NKp30 comprises an anti-NKp30 sequence disclosed herein, e.g., comprises a CDR, VH, VL, heavy chain, or light chain sequence disclosed in Table 20A or Table 20B, Table 22, Table 23A or Table 23B, Table 24, Table 25, Table 26, and Table 21A or Table 21B, or a sequence having at least 70, 80, 90, 95, or 99% identity thereto.

In some embodiments, the multispecific antibody molecule comprises a configuration shown in FIG. 1A. In some embodiments, the multispecific antibody molecule comprises an anti-TRBC1 antibody molecule and an anti-NKp30 antibody molecule, e.g., an anti-TRBC1 antibody molecule comprising two heavy chains and two light chains, and an anti-NKp30 scFv that is fused to the N-terminus of one of the heavy chains of the anti-TRBC1 antibody. In some embodiments, the two heavy chains of the anti-TRBC1 antibody form a heterodimer, e.g., via knob-and-hole mutations. In some embodiments, the two heavy chains of the anti-TRBC1 antibody comprise the N297A mutation. In some embodiments, the two heavy chains of the anti-TRBC1 antibody do not comprise the N297A mutation. In some embodiments, the multispecific antibody molecule comprises a first chain, a second chain, a third chain, and a fourth chain, wherein the first chain comprises an anti-TRBC1 light chain variable region (VL) and a light chain constant region (CL); the second chain comprises an anti-NKp30 scFv, an anti-TRBC1 heavy chain variable region (VH), a CH1, a CH2, and a CH3; the third chain comprises an anti-TRBC1 VH, a CH1, a CH2, and a CH3; and the fourth chain comprises an anti-TRBC1 VL and a CL.

Figure 1B:
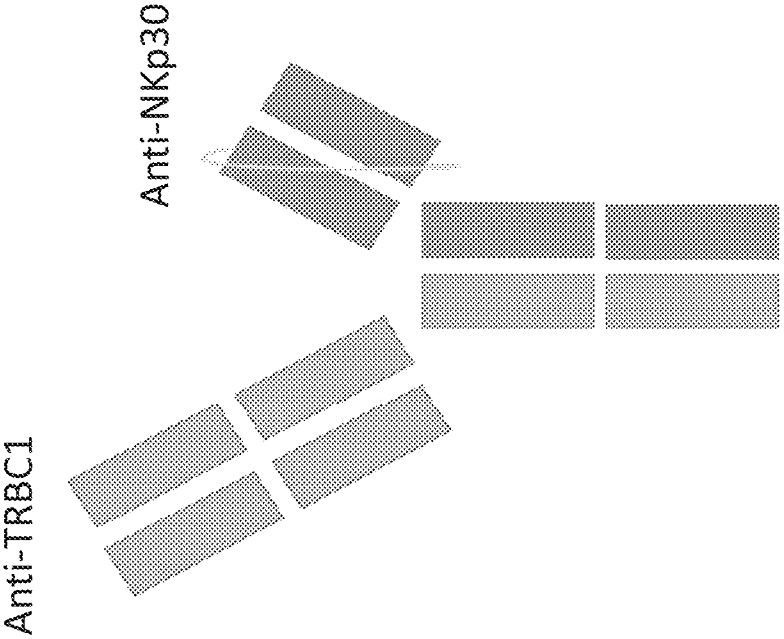

In some embodiments, the multispecific antibody molecule comprises a configuration shown in FIG. 1B. In some embodiments, the multispecific antibody molecule comprises an anti-TRBC1 antibody molecule and an anti-NKp30 antibody molecule. In some embodiments, the multispecific antibody molecule comprises an anti-TRBC1 Fab, an anti-NKp30 scFv, and an Fc dimer comprising two Fc chains. In some embodiments, the C-terminus of the heavy chain of the anti-TRBC1 Fab is fused to the N-terminus of one Fc chain, and the anti-NKp30 scFv is fused to the N-terminus of the other Fc chain. In some embodiments, the two Fc chains form a heterodimer, e.g., via knob-and-hole mutations. In some embodiments, the two Fc chains comprise the N297A mutation. In some embodiments, the two Fc chains do not comprise the N297A mutation. In some embodiments, the multispecific antibody molecule comprises a first chain, a second chain, and a third chain, wherein the first chain comprises an anti-TRBC1 VL and a CL; the second chain comprises an anti-TRBC1 VH, a CH1, a CH2, and a CH3; and the third chain comprises an anti-NKp30 scFv, a CH2, and a CH3.

Figure 1D:
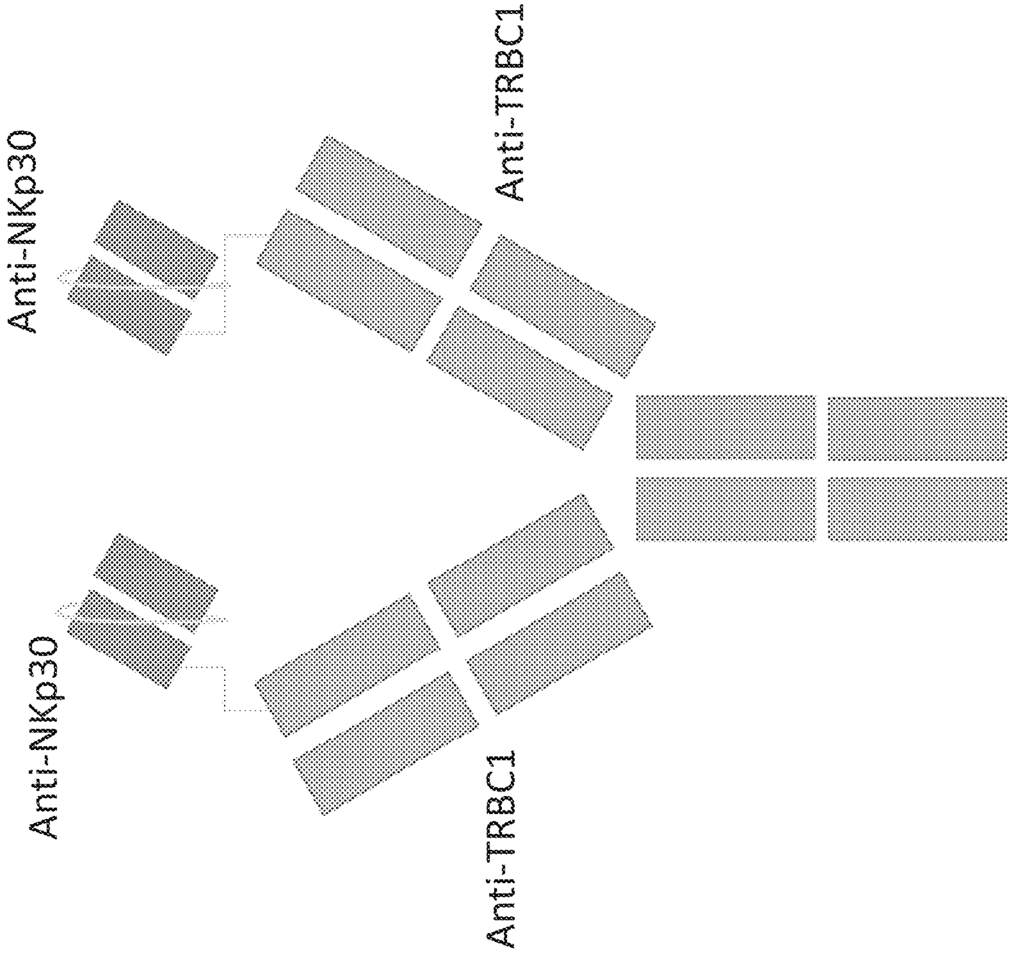
Figure 1C:
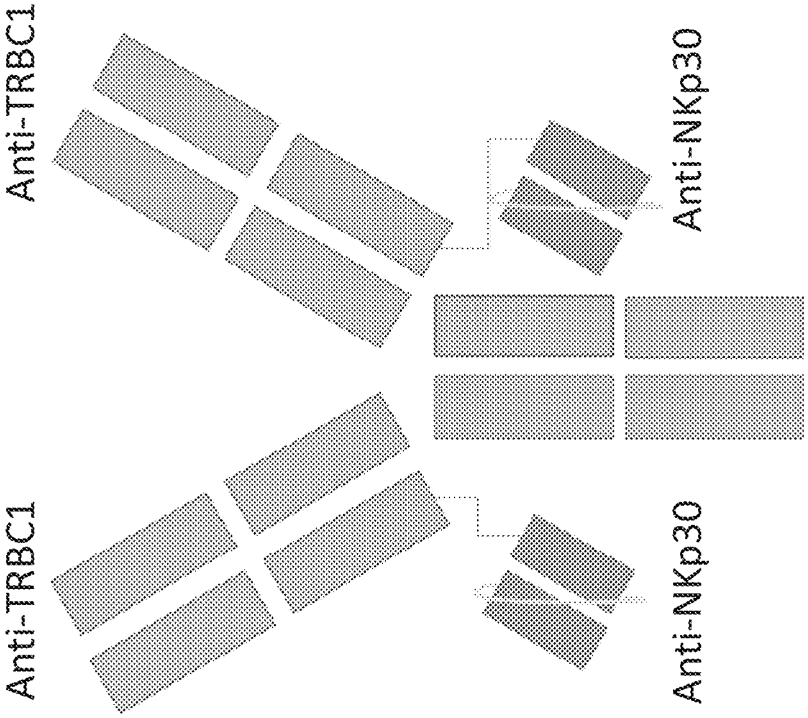
Figure 2A:
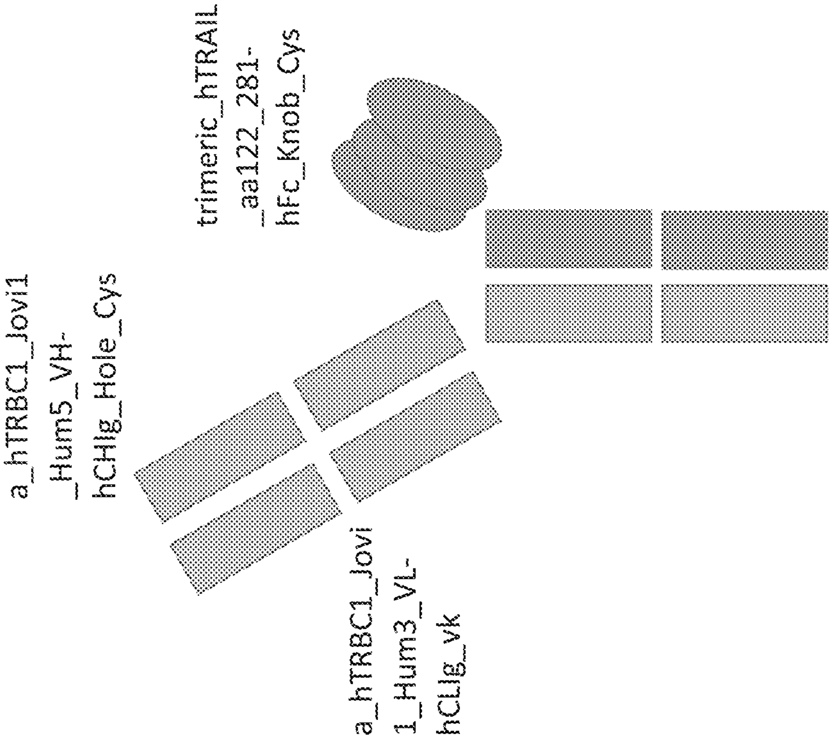
FIGS. 2A-2F are schematic representations of exemplary formats and configurations of antibody molecules that comprises a moiety that binds to TRBC1 and a TRAIL molecule (e.g., a trimeric, dimeric, or monomeric TRAIL molecule).
Figure 2B:
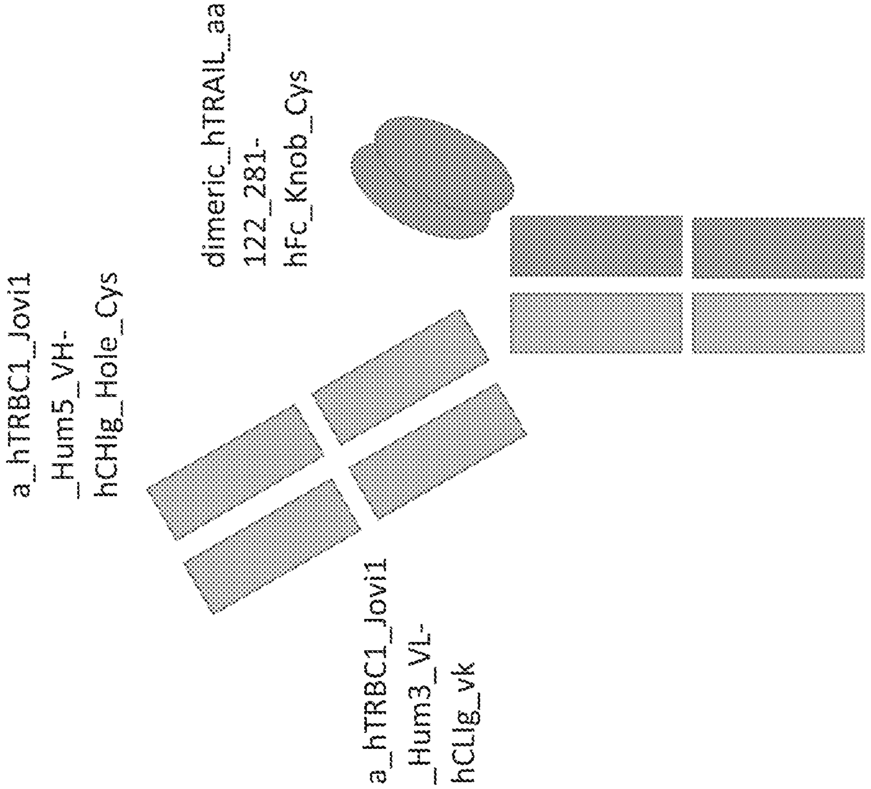
Figure 2D:
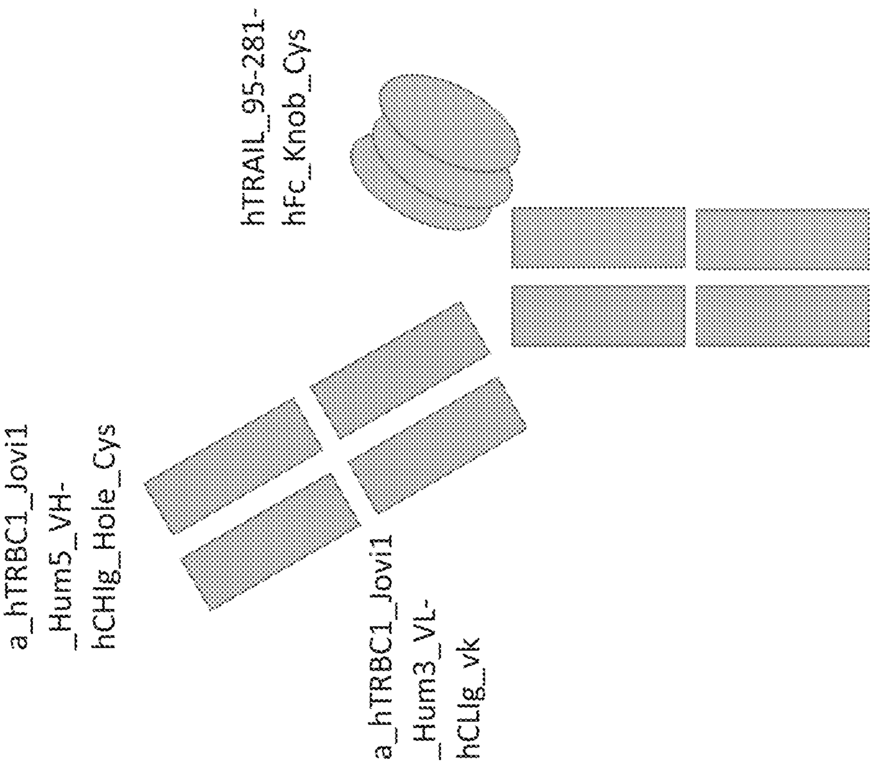
Figure 2C:
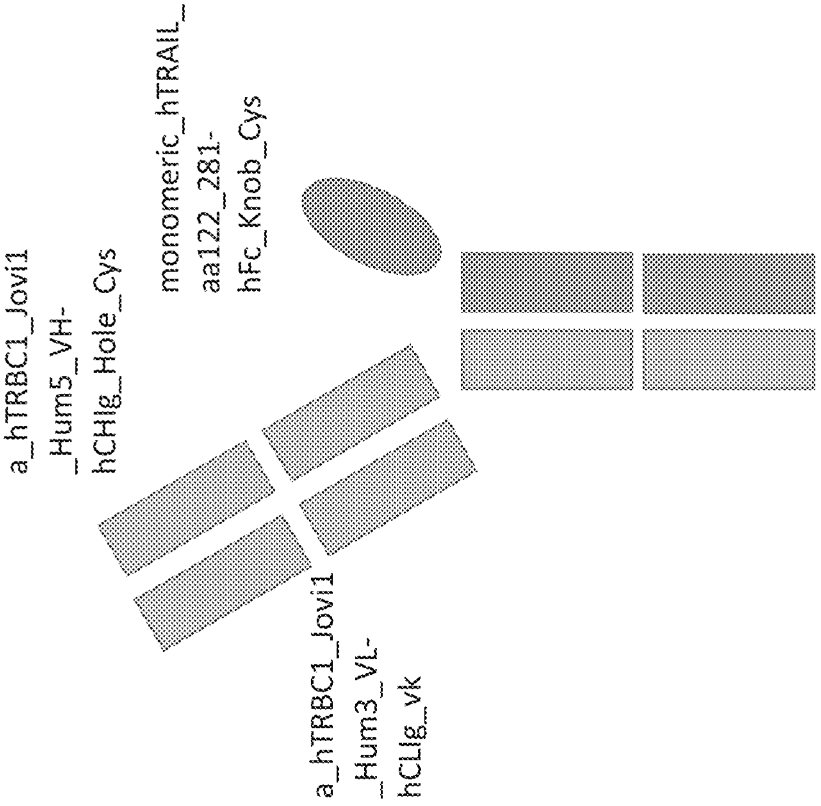
Figure 2F:
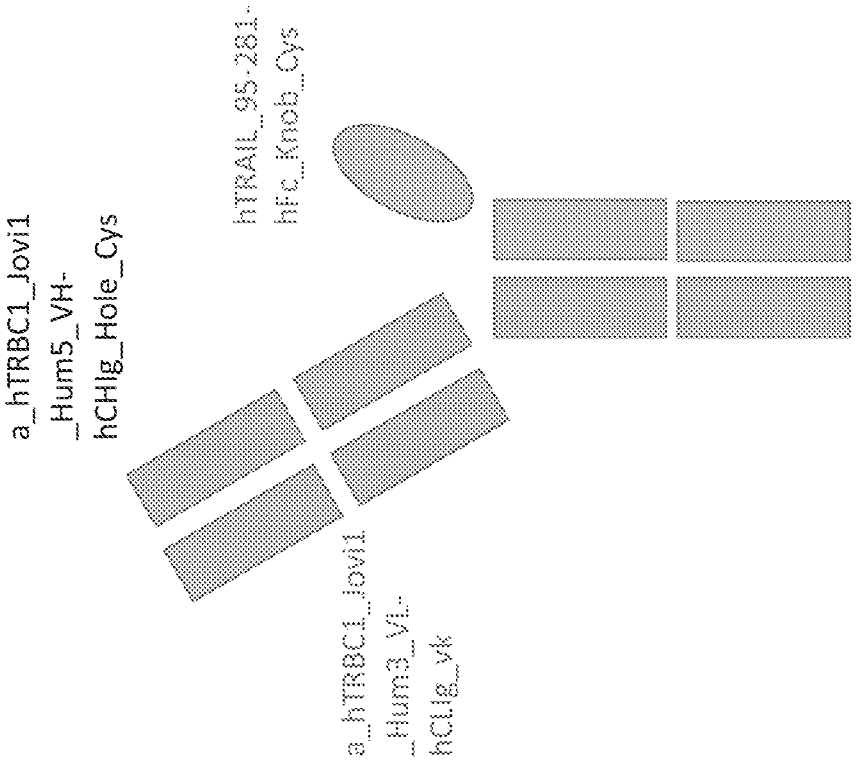
Figure 2E:
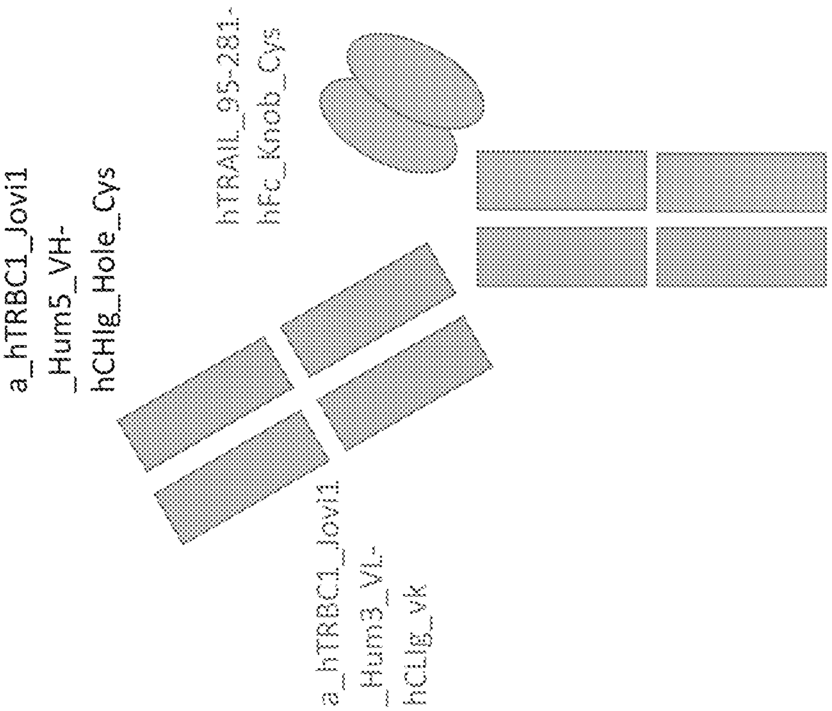

In some embodiments, the multispecific antibody molecule comprises a configuration shown in FIG. 1C. In some embodiments, the multispecific antibody molecule comprises an anti-TRBC1 antibody molecule and an anti-NKp30 antibody molecule, e.g., an anti-TRBC1 antibody molecule comprising two heavy chains and two light chains, and two anti-NKp30 scFvs that are fused to the C-terminus of the two light chains of the anti-TRBC1 antibody molecule, respectively. In some embodiments, the two heavy chains of the anti-TRBC1 antibody form a homodimer. In some embodiments, the two heavy chains of the anti-TRBC1 antibody comprise the N297A mutation. In some embodiments, the two heavy chains of the anti-TRBC1 antibody do not comprise the N297A mutation. In some embodiments, the multispecific antibody molecule comprises a first chain, a second chain, a third chain, and a fourth chain, wherein the first chain comprises an anti-TRBC1 VL, a CL, and an anti-NKp30 scFv; the second chain comprises an anti-TRBC1 VH, a CH1, a CH2, and a CH3; the third chain comprises an anti-TRBC1 VH, a CH1, a CH2, and a CH3; and the fourth chain comprises an anti-TRBC1 VL, a CL, and an anti-NKp30 scFv.

In some embodiments, the multispecific antibody molecule comprises a configuration shown in FIG. 1D. In some embodiments, the multispecific antibody molecule comprises an anti-TRBC1 antibody molecule and an anti-NKp30 antibody molecule, e.g., an anti-TRBC1 antibody molecule comprising two heavy chains and two light chains, and two anti-NKp30 scFvs that are fused to the N-terminus of the two heavy chains of the anti-TRBC1 antibody molecule, respectively. In some embodiments, the two heavy chains of the anti-TRBC1 antibody form a homodimer. In some embodiments, the two heavy chains of the anti-TRBC1 antibody comprise the N297A mutation. In some embodiments, the two heavy chains of the anti-TRBC1 antibody do not comprise the N297A mutation. In some embodiments, the multispecific antibody molecule comprises a first chain, a second chain, a third chain, and a fourth chain, wherein the first chain comprises an anti-TRBC1 VL and a CL; the second chain comprises an anti-NKp30 scFv, an anti-TRBC1 VH, a CH1, a CH2, and a CH3; the third chain comprises an anti-NKp30 scFv, an anti-TRBC1 VH, a CH1, a CH2, and a CH3; and the fourth chain comprises an anti-TRBC1 VL and a CL.

In another aspect, the disclosure features an antibody molecule that comprises a moiety that binds to TRBC1 and a TRAIL molecule (e.g., a trimeric, dimeric, or monomeric TRAIL molecule). In some embodiments, the antibody molecule comprises one or more moieties that bind to TRBC1, e.g., one or more Fabs that bind to TRBC1, e.g., one Fab that binds to TRBC1. In some embodiments, the moiety that binds to TRBC1 comprises an anti-TRBC1 sequence disclosed herein, e.g., comprises a CDR, VH, VL, heavy chain, or light chain sequence disclosed in Table 1, Table 2A or Table 2B, Table 4, Table 7, Table 8, or a sequence having at least 70, 80, 90, 95, or 99% identity thereto. In some embodiments, the antibody molecule comprises a TRAIL molecule (e.g., a trimeric, dimeric, or monomeric TRAIL molecule). In some embodiments, each monomer of TRAIL comprises amino acid residues 122-281 of human TRAIL, or a sequence having at least 70, 80, 90, 95, or 99% identity thereto. In some embodiments, each monomer of TRAIL comprises amino acid residues 95-281 of human TRAIL, or a sequence having at least 70, 80, 90, 95, or 99% identity thereto.

In some embodiments, the antibody molecule comprises a configuration shown in FIGS. 2A-2F. In some embodiments, the antibody molecule comprises a moiety that binds to TRBC1 and a trimeric, dimeric, or monomeric TRAIL molecule, e.g., comprises an anti-TRBC1 Fab, a trimeric, dimeric, or monomeric TRAIL molecule, and an Fc dimer comprising two Fc chains. In some embodiments, the two Fc chains form a heterodimer, e.g., via knob-and-hold mutations. In some embodiments, the two Fc chains comprise the N297A mutation. In some embodiments, the two Fc chains do not comprise the N297A mutation. In some embodiments, the C-terminus of the heavy chain of the anti-TRBC1 Fab is fused to the N-terminus of one Fc chain. In some embodiments, the trimeric, dimeric, or monomeric TRAIL molecule is fused to the N-terminus of the other Fc chain. In some embodiments, the antibody molecule comprises a first chain, a second chain, and a third chain. In some embodiments, the first chain comprises an anti-TRBC1 VL and a CL, e.g., comprises the amino acid sequence of SEQ ID NO: 6169, or a sequence having at least 70, 80, 90, 95, or 99% identity thereto. In some embodiments, the second chain comprises an anti-TRBC1 VH, a CH1, a CH2, and a CH3, e.g., comprises the amino acid sequence of SEQ ID NO: 6167, or a sequence having at least 70, 80, 90, 95, or 99% identity thereto. In some embodiments, the third chain comprises a trimeric TRAIL molecule, a CH2, and a CH3, e.g., comprises the amino acid sequence of SEQ ID NO: 6159 or 6162, or a sequence having at least 70, 80, 90, 95, or 99% identity thereto. In some embodiments, the third chain comprises a dimeric TRAIL molecule, a CH2, and a CH3, e.g., comprises the amino acid sequence of SEQ ID NO: 6158 or 6161, or a sequence having at least 70, 80, 90, 95, or 99% identity thereto. In some embodiments, the third chain comprises a monomeric TRAIL molecule, a CH2, and a CH3, e.g., comprises the amino acid sequence of SEQ ID NO: 6157 or 6160, or a sequence having at least 70, 80, 90, 95, or 99% identity thereto.

In another aspect, the disclosure features a multispecific antibody molecule (e.g., a bispecific antibody molecule) that binds to TRBC1 and DR5. In some embodiments, the multispecific antibody molecule comprises one or more moieties that bind to TRBC1, e.g., one or more Fabs that bind to TRBC1, e.g., one Fab that binds to TRBC1. In some embodiments, the multispecific antibody molecule comprises one or more moieties that bind to DR5, e.g., one or more scFvs that bind to DR5, e.g., one or two scFvs that bind to DR5. In some embodiments, the moiety that binds to TRBC1 comprises an anti-TRBC1 sequence disclosed herein, e.g., comprises a CDR, VH, VL, heavy chain, or light chain sequence disclosed in Table 1, Table 2A or Table 2B, Table 4, Table 7, Table 8, or a sequence having at least 70, 80, 90, 95, or 99% identity thereto. In some embodiments, the moiety that binds to DR5 comprises an anti-DR5 sequence disclosed herein, e.g., comprises a CDR, VH, VL, heavy chain, or light chain sequence disclosed in Table 28, or a sequence having at least 70, 80, 90, 95, or 99% identity thereto.

Figure 3A:
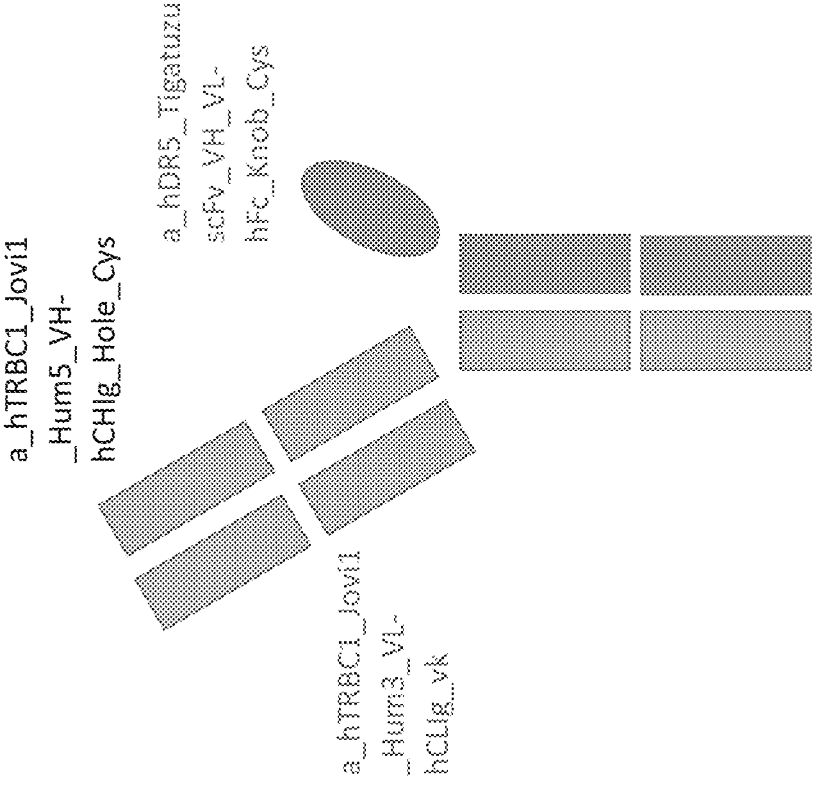
FIGS. 3A and 3B are schematic representations of exemplary formats and configurations of multispecific antibodies (e.g., bispecific antibodies) that bind to TRBC1 and DR5.

In some embodiments, the multispecific antibody molecule comprises a configuration shown in FIG. 3A. In some embodiments, the multispecific antibody molecule comprises an anti-TRBC1 Fab, an anti-DR5 scFv, and an Fc dimer comprising two Fc chains. In some embodiments, the two Fc chains form a heterodimer, e.g., via knob-and-hold mutations. In some embodiments, the two Fc chains comprise the N297A mutation. In some embodiments, the two Fc chains do not comprise the N297A mutation. In some embodiments, the C-terminus of the heavy chain of the anti-TRBC1 Fab is fused to the N-terminus of one Fc chain. In some embodiments, the anti-DR5 scFv is fused to the N-terminus of the other Fc chain. In some embodiments, the multispecific antibody molecule comprises a first chain, a second chain, and a third chain. In some embodiments, the first chain comprises an anti-TRBC1 VL and a CL, e.g., comprises the amino acid sequence of SEQ ID NO: 6169, or a sequence having at least 70, 80, 90, 95, or 99% identity thereto. In some embodiments, the second chain comprises an anti-TRBC1 VH, a CH1, a CH2, and a CH3, e.g., comprises the amino acid sequence of SEQ ID NO: 6167, or a sequence having at least 70, 80, 90, 95, or 99% identity thereto. In some embodiments, the third chain comprises an anti-DR5 scFv, a CH2, and a CH3, e.g., comprises the amino acid sequence of SEQ ID NO: 6163, or a sequence having at least 70, 80, 90, 95, or 99% identity thereto.

Figure 3B:
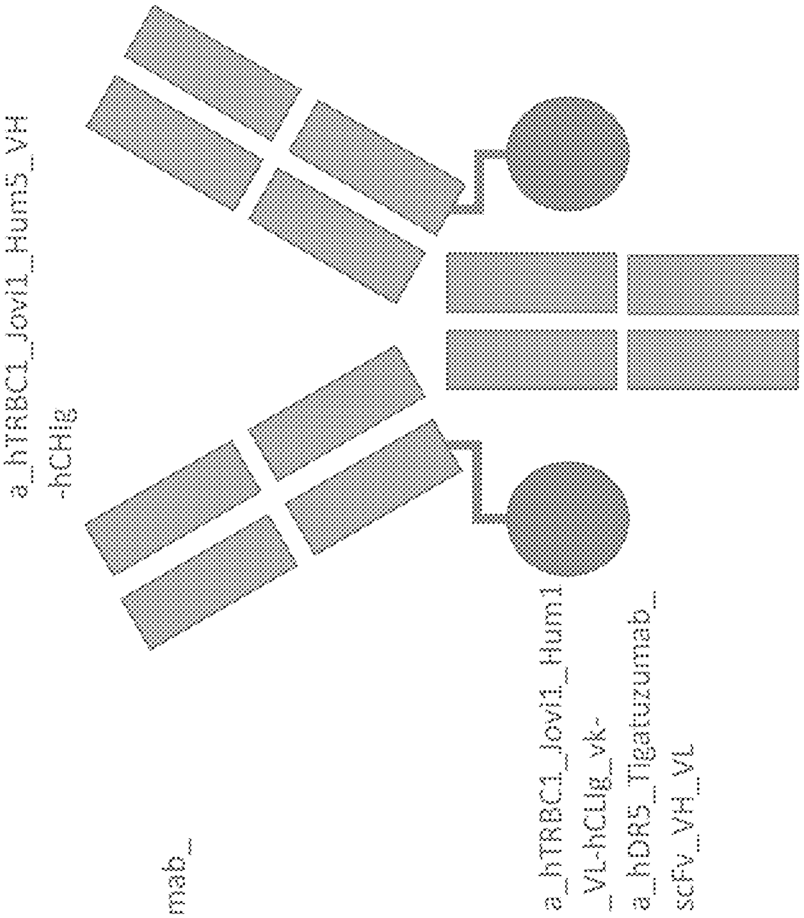

In some embodiments, the multispecific antibody molecule comprises a configuration shown in FIG. 3B. In some embodiments, the multispecific antibody molecule comprises an anti-TRBC1 antibody molecule and an anti-DR5 antibody molecule, e.g., an anti-TRBC1 antibody molecule comprising two heavy chains and two light chains, and two anti-DR5 scFvs that are fused to the C-terminus of the two light chains of the anti-TRBC1 antibody, respectively. In some embodiments, the two heavy chains of the anti-TRBC1 antibody comprise the N297A mutation. In some embodiments, the two heavy chains of the anti-TRBC1 antibody do not comprise the N297A mutation. In some embodiments, the multispecific antibody molecule comprises a first chain, a second chain, a third chain, and a fourth chain. In some embodiments, the first chain comprises an anti-TRBC1 VL, a CL, and an anti-DR5 scFv, e.g., comprises the amino acid sequence of SEQ ID NO: 6170, or a sequence having at least 70, 80, 90, 95, or 99% identity thereto. In some embodiments, the second chain comprises an anti-TRBC1 VH, a CH1, a CH2, and a CH3, e.g., comprises the amino acid sequence of SEQ ID NO: 6168, or a sequence having at least 70, 80, 90, 95, or 99% identity thereto. In some embodiments, the fourth chain comprises an anti-TRBC1 VH, a CH1, a CH2, and a CH3, e.g., comprises the amino acid sequence of SEQ ID NO: 6168, or a sequence having at least 70, 80, 90, 95, or 99% identity thereto. In some embodiments, the first chain comprises an anti-TRBC1 VL, a CL, and an anti-DR5 scFv, e.g., comprises the amino acid sequence of SEQ ID NO: 6170, or a sequence having at least 70, 80, 90, 95, or 99% identity thereto.

Uses of the antibody molecules disclosed herein include but are not limited to methods of treating cancer (e.g., a cancer expressing TRBC1) disclosed herein; methods of identifying, evaluating, or selecting a subject in need of treatment (e.g., determining whether a subject has cancer cells that express TRBC1) disclosed herein; and methods of laboratory or diagnostic analysis (e.g., immunological assays comprising detecting the presence and/or level of TRBC1 or TRBC1 expressing cells).

Cytokine Molecules and Cytokine Inhibitor Molecules

Cytokines are generally polypeptides that influence cellular activity, for example, through signal transduction pathways. Accordingly, a cytokine of the multispecific or multifunctional polypeptide is useful and can be associated with receptor-mediated signaling that transmits a signal from outside the cell membrane to modulate a response within the cell. Cytokines are proteinaceous signaling compounds that are mediators of the immune response. They control many different cellular functions including proliferation, differentiation and cell survival/apoptosis; cytokines are also involved in several pathophysiological processes including viral infections and autoimmune diseases. Cytokines are synthesized under various stimuli by a variety of cells of both the innate (monocytes, macrophages, dendritic cells) and adaptive (T- and B-cells) immune systems. Cytokines can be classified into two groups: pro- and anti-inflammatory. Pro-inflammatory cytokines, including IFNγ, IL-1, IL-6 and TNF-alpha, are predominantly derived from the innate immune cells and Th1 cells. Anti-inflammatory cytokines, including IL-10, IL-4, IL-13 and IL-5, are synthesized from Th2 immune cells.

The present disclosure provides, inter alia, multispecific (e.g., bi-, tri-, quad-specific) or multifunctional molecules, that include, e.g., are engineered to contain, one or more cytokine molecules, e.g., immunomodulatory (e.g., proinflammatory) cytokines and variants, e.g., functional variants, thereof. Accordingly, in some embodiments, the cytokine molecule is an interleukin or a variant, e.g., a functional variant thereof. In some embodiments the interleukin is a proinflammatory interleukin. In some embodiments the interleukin is chosen from interleukin-2 (IL-2), interleukin-12 (IL-12), interleukin-15 (IL-15), interleukin-18 (IL-18), interleukin-21 (IL-21), interleukin-7 (IL-7), or interferon gamma. In some embodiments, the cytokine molecule is a proinflammatory cytokine.

In certain embodiments, the cytokine is a single chain cytokine. In certain embodiments, the cytokine is a multichain cytokine (e.g., the cytokine comprises 2 or more (e.g., 2) polypeptide chains. An exemplary multichain cytokine is IL-12.

Examples of useful cytokines include, but are not limited to, GM-CSF, IL-1α, IL-1β, IL-2, IL-3, IL-4, IL-5, IL-6, IL-7, IL-8, IL-10, IL-12, IL-21, IFN-α, IFN-β, IFN-γ, MIP-1α, MIP-1β, TGF-β, TNF-α, and TNFβ. In one embodiment the cytokine of the multispecific or multifunctional polypeptide is a cytokine selected from the group of GM-CSF, IL-2, IL-7, IL-8, IL-10, IL-12, IL-15, IL-21, IFN-α, IFN-γ, MIP-1α, MIP-1β and TGF-β. In one embodiment the cytokine of the i the multispecific or multifunctional polypeptide is a cytokine selected from the group of IL-2, IL-7, IL-10, IL-12, IL-15, IFN-α, and IFN-γ. In certain embodiments the cytokine is mutated to remove N- and/or O-glycosylation sites. Elimination of glycosylation increases homogeneity of the product obtainable in recombinant production.

In one embodiment, the cytokine of the multispecific or multifunctional polypeptide is IL-2. In a specific embodiment, the IL-2 cytokine can elicit one or more of the cellular responses selected from the group consisting of: proliferation in an activated T lymphocyte cell, differentiation in an activated T lymphocyte cell, cytotoxic T cell (CTL) activity, proliferation in an activated B cell, differentiation in an activated B cell, proliferation in a natural killer (NK) cell, differentiation in a NK cell, cytokine secretion by an activated T cell or an NK cell, and NK/lymphocyte activated killer (LAK) antitumor cytotoxicity. In another particular embodiment the IL-2 cytokine is a mutant IL-2 cytokine having reduced binding affinity to the .alpha.-subunit of the IL-2 receptor. Together with the .beta.- and .gamma.-subunits (also known as CD122 and CD132, respectively), the .alpha.-subunit (also known as CD25) forms the heterotrimeric high-affinity IL-2 receptor, while the dimeric receptor consisting only of the β- and γ-subunits is termed the intermediate-affinity IL-2 receptor. As described in PCT patent application number PCT/EP2012/051991, which is incorporated herein by reference in its entirety, a mutant IL-2 polypeptide with reduced binding to the .alpha.-subunit of the IL-2 receptor has a reduced ability to induce IL-2 signaling in regulatory T cells, induces less activation-induced cell death (AICD) in T cells, and has a reduced toxicity profile in vivo, compared to a wild-type IL-2 polypeptide. The use of such a cytokine with reduced toxicity is particularly advantageous in a multispecific or multifunctional polypeptide according to the invention, having a long serum half-life due to the presence of an Fc domain. In one embodiment, the mutant IL-2 cytokine of the multispecific or multifunctional polypeptide according to the invention comprises at least one amino acid mutation that reduces or abolishes the affinity of the mutant IL-2 cytokine to the .alpha.-subunit of the IL-2 receptor (CD25) but preserves the affinity of the mutant IL-2 cytokine to the intermediate-affinity IL-2 receptor (consisting of the β and γ subunits of the IL-2 receptor), compared to the non-mutated IL-2 cytokine. In one embodiment the one or more amino acid mutations are amino acid substitutions. In a specific embodiment, the mutant IL-2 cytokine comprises one, two or three amino acid substitutions at one, two or three position(s) selected from the positions corresponding to residue 42, 45, and 72 of human IL-2. In a more specific embodiment, the mutant IL-2 cytokine comprises three amino acid substitutions at the positions corresponding to residue 42, 45 and 72 of human IL-2. In an even more specific embodiment, the mutant IL-2 cytokine is human IL-2 comprising the amino acid substitutions F42A, Y45A and L72G. In one embodiment the mutant IL-2 cytokine additionally comprises an amino acid mutation at a position corresponding to position 3 of human IL-2, which eliminates the O-glycosylation site of IL-2. Particularly, said additional amino acid mutation is an amino acid substitution replacing a threonine residue by an alanine residue. A particular mutant IL-2 cytokine useful in the invention comprises four amino acid substitutions at positions corresponding to residues 3, 42, 45 and 72 of human IL-2. Specific amino acid substitutions are T3A, F42A, Y45A and L72G. As demonstrated in PCT patent application number PCT/EP2012/051991 and in the appended Examples, said quadruple mutant IL-2 polypeptide (IL-2 qm) exhibits no detectable binding to CD25, reduced ability to induce apoptosis in T cells, reduced ability to induce IL-2 signaling in T.sub.reg cells, and a reduced toxicity profile in vivo. However, it retains ability to activate IL-2 signaling in effector cells, to induce proliferation of effector cells, and to generate IFN-γ as a secondary cytokine by NK cells.

The IL-2 or mutant IL-2 cytokine according to any of the above embodiments may comprise additional mutations that provide further advantages such as increased expression or stability. For example, the cysteine at position 125 may be replaced with a neutral amino acid such as alanine, to avoid the formation of disulfide-bridged IL-2 dimers. Thus, in certain embodiments the IL-2 or mutant IL-2 cytokine of the multispecific or multifunctional polypeptide according to the invention comprises an additional amino acid mutation at a position corresponding to residue 125 of human IL-2. In one embodiment said additional amino acid mutation is the amino acid substitution C125A.

In a specific embodiment the IL-2 cytokine of the multispecific or multifunctional polypeptide comprises the polypeptide sequence of SEQ ID NO: 7227

[APTSSSTKKTQLQLEHLLLDLQMILNGINNYKNPKLTRMLTFKFYMPK

KATELKHLQCLEEELKPLEEVLNLAQSKNFHLRPRDLISNINVIVLELK

GSETTFMCEYADETATIVEFLNRWITFAQSIISTLT]

In another specific embodiment the IL-2 cytokine of the multispecific or multifunctional polypeptide comprises the polypeptide sequence of SEQ ID NO: 7228

[APASSSTKKT QLQLEHLLLD LOMILNGINN YKNPKLTRMLTAKFA

MPKKATELKHLQCLE EELKPLEEVLNGAQSKNFHL RPRDLISNIN V

IVLELKGSETTFMCEYADETATIVEFLNRWITFAQSIISTLT].

In another embodiment the cytokine of the multispecific or multifunctional polypeptide is IL-12. In a specific embodiment said IL-12 cytokine is a single chain IL-12 cytokine. In an even more specific embodiment the single chain IL-12 cytokine comprises the polypeptide sequence of SEQ ID NO: 7229

[IWELKKDVYVVELDWYPDAPGEMVVLTCDTPEEDGITWTLDQSSEVLG

SGKTLTIQVKEFGDAGQYTCHKGGEVLSHSLLLLHKKEDGIWSTDILKD

QKEPKNKTFLRCEAKNYSGRFTCWWLTTISTDLTFSVKSSRGSSDPQGV

TCGAATLSAERVRGDNKEYEYSVECQEDSACPAAEESLPIEVMVDAVHK

LKYENYTSSFFIRDIIKPDPPKNLQLKPLKNSRQVEVSWEYPDTWSTPH

SYFSLTFCVQVQGKSKREKKDRVFTDKTSATVICRKNASISVRAQDRYY

SSSWSEWASVPCSGGGGSGGGGSGGGGSRNLPVATPDPGMFPCLHHSQN

LLRAVSNMLQKARQTLEFYPCTSEEIDHEDITKDKTSTVEACLPLELTK

-continued

NESCLNSRETSFITNGSCLASRKTSFMMALCLSSIYEDLKMYQVEFKTM

NAKLLMDPKRQIFLDQNMLAVIDELMQALNFNSETVPQKSSLEEPDFYK

TKIKLCILLHAFRIRAVTIDRVMSYLNAS].

In one embodiment, the IL-12 cytokine can elicit one or more of the cellular responses selected from the group consisting of: proliferation in a NK cell, differentiation in a NK cell, proliferation in a T cell, and differentiation in a T cell.

In another embodiment the cytokine of the multispecific or multifunctional polypeptide is IL-10. In a specific embodiment said IL-10 cytokine is a single chain IL-10 cytokine. In an even more specific embodiment the single chain IL-10 cytokine comprises the polypeptide sequence of SEQ ID NO: 7230

[SPGQGTQSENSCTHFPGNLPNMLRDLRDAFSRVKTFFQMKDQLDNLLL

KESLLEDFKGYLGCQALSEMIQFYLEEVMPQAENQDPDIKAHVNSLGEN

LKTLRLRLRRCHRFLPCENKSKAVEQVKNAFNKLQEKGIYKAMSEFDIF

INYIEAYMTMKIRNGGGGSGGGGSGGGGSGGGGSSPGQGTQSENSCTHF

PGNLPNMLRDLRDAFSRVKTFFQMKDQLDNLLLKESLLEDFKGYLGCQA

LSEMIQFYLEEVMPQAENQDPDIKAHVNSLGENLKTLRLRLRRCHRFLP

CENKSKAVEQVKNAFNKLQEKGIYKAMSEFDIFINYIEAYMTMKIRN]

In another specific embodiment the IL-10 cytokine is a monomeric IL-10 cytokine. In a more specific embodiment the monomeric IL-10 cytokine comprises the polypeptide sequence of SEQ ID NO: 7231,

SPGQGTQSENSCTHFPGNLPNMLRDLRDAFSRVKTFFQMKDQLDNLLLK

ESLLEDFKGYLGCQALSEMIQFYLEEVMPQAENQDPDIKAHVNSLGENL

KTLRLRLRRCHRFLPCENGGGSGGKSKAVEQVKNAFNKLQEKGIYKAMS

EFDIFINYIEAYMTMKIRN.

In one embodiment, the IL-10 cytokine can elicit one or more of the cellular responses selected from the group consisting of: inhibition of cytokine secretion, inhibition of antigen presentation by antigen presenting cells, reduction of oxygen radical release, and inhibition of T cell proliferation. A multispecific or multifunctional polypeptide according to the invention wherein the cytokine is IL-10 is particularly useful for downregulation of inflammation, e.g. in the treatment of an inflammatory disorder.

In another embodiment, the cytokine of the multispecific or multifunctional polypeptide is IL-15. In a specific embodiment said IL-15 cytokine is a mutant IL-15 cytokine having reduced binding affinity to the α-subunit of the IL-15 receptor. Without wishing to be bound by theory, a mutant IL-15 polypeptide with reduced binding to the .alpha.-subunit of the IL-15 receptor has a reduced ability to bind to fibroblasts throughout the body, resulting in improved pharmacokinetics and toxicity profile, compared to a wild-type IL-15 polypeptide. The use of a cytokine with reduced toxicity, such as the described mutant IL-2 and mutant IL-15 effector moieties, is particularly advantageous in a multispecific or multifunctional polypeptide according to the invention, having a long serum half-life due to the presence of an Fc domain. In one embodiment the mutant IL-15 cytokine of the multispecific or multifunctional polypeptide according to the invention comprises at least one amino acid mutation that reduces or abolishes the affinity of the mutant IL-15 cytokine to the .alpha.-subunit of the IL-15 receptor but preserves the affinity of the mutant IL-15 cytokine to the intermediate-affinity IL-15/IL-2 receptor (consisting of the .beta.- and .gamma.-subunits of the IL-15/IL-2 receptor), compared to the non-mutated IL-15 cytokine. In one embodiment the amino acid mutation is an amino acid substitution. In a specific embodiment, the mutant IL-15 cytokine comprises an amino acid substitution at the position corresponding to residue 53 of human IL-15. In a more specific embodiment, the mutant IL-15 cytokine is human IL-15 comprising the amino acid substitution E53A. In one embodiment the mutant IL-15 cytokine additionally comprises an amino acid mutation at a position corresponding to position 79 of human IL-15, which eliminates the N-glycosylation site of IL-15. Particularly, said additional amino acid mutation is an amino acid substitution replacing an asparagine residue by an alanine residue. In an even more specific embodiment the IL-15 cytokine comprises the polypeptide sequence of SEQ ID NO: 7232,

NWVNVISDLKKIEDLIQSMHIDATLYTESDVHPSCKVTAMKCFLLELQV

ISLASGDASIHDTVENLIILANNSLSSNGAVTESGCKECEELEEKNIKE

FLQSFVHIVQMFINTS.

In one embodiment, the IL-15 cytokine can elicit one or more of the cellular responses selected from the group consisting of: proliferation in an activated T lymphocyte cell, differentiation in an activated T lymphocyte cell, cytotoxic T cell (CTL) activity, proliferation in an activated B cell, differentiation in an activated B cell, proliferation in a natural killer (NK) cell, differentiation in a NK cell, cytokine secretion by an activated T cell or an NK cell, and NK/lymphocyte activated killer (LAK) antitumor cytotoxicity.

Mutant cytokine molecules useful as effector moieties in the multispecific or multifunctional polypeptide can be prepared by deletion, substitution, insertion or modification using genetic or chemical methods well known in the art. Genetic methods may include site-specific mutagenesis of the encoding DNA sequence, PCR, gene synthesis, and the like. The correct nucleotide changes can be verified for example by sequencing. Substitution or insertion may involve natural as well as non-natural amino acid residues. Amino acid modification includes well known methods of chemical modification such as the addition or removal of glycosylation sites or carbohydrate attachments, and the like.

In one embodiment, the cytokine, particularly a single-chain cytokine, of the multispecific or multifunctional polypeptide is GM-CSF. In a specific embodiment, the GM-CSF cytokine can elicit proliferation and/or differentiation in a granulocyte, a monocyte or a dendritic cell. In one embodiment, the cytokine, particularly a single-chain cytokine, of the multispecific or multifunctional polypeptide is IFN-α. In a specific embodiment, the IFN-α cytokine can elicit one or more of the cellular responses selected from the group consisting of inhibiting viral replication in a virus-infected cell, and upregulating the expression of major histocompatibility complex I (MHC I). In another specific embodiment, the IFN-α cytokine can inhibit proliferation in a tumor cell. In one embodiment the cytokine, particularly a single-chain cytokine, of the multispecific or multifunctional polypeptide is IFNγ. In a specific embodiment, the IFN-γ cytokine can elicit one or more of the cellular responses selected from the group of increased macrophage activity, increased expression of MHC molecules, and increased NK cell activity. In one embodiment the cytokine, particularly a single-chain cytokine, of the multispecific or multifunctional polypeptide is IL-7. In a specific embodiment, the IL-7 cytokine can elicit proliferation of T and/or B lymphocytes. In one embodiment, the cytokine, particularly a single-chain cytokine, of the multispecific or multifunctional polypeptide is IL-8. In a specific embodiment, the IL-8 cytokine can elicit chemotaxis in neutrophils. In one embodiment, the cytokine, particularly a single-chain cytokine, of the multispecific or multifunctional polypeptide, is MIP-1α. In a specific embodiment, the MIP-1α cytokine can elicit chemotaxis in monocytes and T lymphocyte cells. In one embodiment, the cytokine, particularly a single-chain cytokine, of the multispecific or multifunctional polypeptide is MIP-1β. In a specific embodiment, the MIP-1β cytokine can elicit chemotaxis in monocytes and T lymphocyte cells. In one embodiment, the cytokine, particularly a single-chain cytokine, of the multispecific or multifunctional polypeptide is TGF-β. In a specific embodiment, the TGF-β cytokine can elicit one or more of the cellular responses selected from the group consisting of chemotaxis in monocytes, chemotaxis in macrophages, upregulation of IL-1 expression in activated macrophages, and upregulation of IgA expression in activated B cells.

In one embodiment, the multispecific or multifunctional polypeptide of the invention binds to an cytokine receptor with a dissociation constant ($K_D$) that is at least about 1, 1.5, 2, 2.5, 3, 3.5, 4, 4.5, 5, 5.5, 6, 6.5, 7, 7.5, 8, 8.5, 9, 9.5 or 10 times greater than that for a control cytokine. In another embodiment, the multispecific or multifunctional polypeptide binds to an cytokine receptor with a $K_D$ that is at least 2, 3, 4, 5, 6, 7, 8, 9, or 10 times greater than that for a corresponding multispecific or multifunctional polypeptide comprising two or more effector moieties. In another embodiment, the multispecific or multifunctional polypeptide binds to an cytokine receptor with a dissociation constant $K_D$ that is about 10 times greater than that for a corresponding the multispecific or multifunctional polypeptide comprising two or more cytokines.

In some embodiments, the multispecific molecules disclosed herein include a cytokine molecule. In embodiments, the cytokine molecule includes a full length, a fragment or a variant of a cytokine; a cytokine receptor domain, e.g., a cytokine receptor dimerizing domain; or an agonist of a cytokine receptor, e.g., an antibody molecule (e.g., an agonistic antibody) to a cytokine receptor.

In some embodiments the cytokine molecule is chosen from IL-2, IL-12, IL-15, IL-18, IL-7, IL-21, or interferon gamma, or a fragment or variant thereof, or a combination of any of the aforesaid cytokines. The cytokine molecule can be a monomer or a dimer. In embodiments, the cytokine molecule can further include a cytokine receptor dimerizing domain.

In other embodiments, the cytokine molecule is an agonist of a cytokine receptor, e.g., an antibody molecule (e.g., an agonistic antibody) to a cytokine receptor chosen from an IL-15Ra or IL-21R.

In one embodiment, the cytokine molecule is IL-15, e.g., human IL-15 (e.g., comprising the amino acid sequence:

```
                                    (SEQ ID NO: 7017)
NWVNVISDLKKIEDLIQSMHIDATLYTESDVHPSCKVTAMKCFLLELQV

ISLESGDASIHDTVENLIILANNSLSSNGNVTESGCKECEELEEKNIKE

FLQSFVHIVQMFINTS,
```

a fragment thereof, or an amino acid sequence substantially identical thereto (e.g., 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7017.

In some embodiments, the cytokine molecule comprises a receptor dimerizing domain, e.g., an IL15Ralpha dimerizing domain. In one embodiment, the IL15Ralpha dimerizing domain comprises the amino acid sequence:

```
                                    (SEQ ID NO: 7018)
MAPRRARGCRTLGLPALLLLLLLRPPATRGITCPPPMSVEHADIWVKSY
SLYSRERYICNSGFKRKAGTSSLTECVL,
```

a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7018. In some embodiments, the cytokine molecule (e.g., IL-15) and the receptor dimerizing domain (e.g., an IL15Ralpha dimerizing domain) of the multispecific molecule are covalently linked, e.g., via a linker (e.g., a Gly-Ser linker, e.g., a linker comprising the amino acid sequence SGGSGGGGSGGGSGGGGSLQ (SEQ ID NO: 7019). In other embodiments, the cytokine molecule (e.g., IL-15) and the receptor dimerizing domain (e.g., an IL15Ralpha dimerizing domain) of the multispecific molecule are not covalently linked, e.g., are non-covalently associated.

In other embodiments, the cytokine molecule is IL-2, e.g., human IL-2 (e.g., comprising the amino acid sequence:

```
                                    (SEQ ID NO: 7020)
APTSSSTKKTQLQLEHLLLDLQMILNGINNYKNPKLTRMLTFKFYMPKK

ATELKHLQCLEEELKPLEEVLNLAQSKNFHLRPRDLISNINVIVLELKG

SETTFMCEYADETATIVEFLNRWITFCQSIISTLT,
```

a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7020).

In other embodiments, the cytokine molecule is IL-18, e.g., human IL-18 (e.g., comprising the amino acid sequence:

```
                                    (SEQ ID NO: 7021)
YFGKLESKLSVIRNLNDQVLFIDQGNRPLFEDMTDSDCRDNAPRTIFII

SMYKDSQPRGMAVTISVKCEKISTLSCENKIISFKEMNPPDNIKDTKSD

IIFFQRSVPGHDNKMQFESSSYEGYFLACEKERDLFKLILKKEDELGDR

SIMFTVQNED,
```

a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7021).

In other embodiments, the cytokine molecule is IL-21, e.g., human IL-21 (e.g., comprising the amino acid sequence:

(SEQ ID NO: 7022)
QGQDRHMIRMRQLIDIVDQLKNYVNDLVPEFLPAPEDVETNCEWSAFSC

FQKAQLKSANTGNNERIINVSIKKLKRKPPSTNAGRRQKHRLTCPSCDS

YEKKPPKEFLERFKSLLQKMIHQHLSSRTHGSEDS.

a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7022).

In yet other embodiments, the cytokine molecule is interferon gamma, e.g., human interferon gamma (e.g., comprising the amino acid sequence:

(SEQ ID NO: 7023)
QDPYVKEAENLKKYFNAGHSDVADNGTLFLGILKNWKEESDRKIMQSQI

VSFYFKLFKNFKDDQSIQKSVETIKEDMNVKFFNSNKKKRDDFEKLTNY

SVTDLNVQRKAIHELIQVMAELSPAAKTGKRKRSQMLFRG.

a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7023).

TGF-Beta Inhibitors

The present disclosure further provides, inter alia, multispecific (e.g., bi-, tri-, quad-specific) or multifunctional molecules, that include, e.g., are engineered to contain, one or more cytokine inhibitor molecules, e.g., inhibitors of immunomodulatory (e.g., proinflammatory) cytokines and variants, e.g., functional variants, thereof. Accordingly, in some embodiments, the cytokine inhibitor molecule is a TGF-beta inhibitor. In some embodiments, the TGF-beta inhibitor binds to and inhibits TGF-beta, e.g., reduces the activity of TGF-beta. In some embodiments, the TGF-beta inhibitor inhibits (e.g., reduces the activity of) TGF-beta 1. In some embodiments, the TGF-beta inhibitor inhibits (e.g., reduces the activity of) TGF-beta 2. In some embodiments, the TGF-beta inhibitor inhibits (e.g., reduces the activity of) TGF-beta 3. In some embodiments, the TGF-beta inhibitor inhibits (e.g., reduces the activity of) TGF-beta 1 and TGF-beta 3. In some embodiments, the TGF-beta inhibitor inhibits (e.g., reduces the activity of) TGF-beta 1, TGF-beta 2, and TGF-beta 3.

In some embodiments, the TGF-beta inhibitor comprises a portion of a TGF-beta receptor (e.g., an extracellular domain of a TGF-beta receptor) that is capable of inhibiting (e.g., reducing the activity of) TGF-beta, or functional fragment or variant thereof. In some embodiments, the TGF-beta inhibitor comprises a TGFBR1 polypeptide (e.g., an extracellular domain of TGFBR1 or functional variant thereof). In some embodiments, the TGF-beta inhibitor comprises a TGFBR2 polypeptide (e.g., an extracellular domain of TGFBR2 or functional variant thereof). In some embodiments, the TGF-beta inhibitor comprises a TGFBR3 polypeptide (e.g., an extracellular domain of TGFBR3 or functional variant thereof). In some embodiments, the TGF-beta inhibitor comprises a TGFBR1 polypeptide (e.g., an extracellular domain of TGFBR1 or functional variant thereof) and a TGFBR2 polypeptide (e.g., an extracellular domain of TGFBR2 or functional variant thereof). In some embodiments, the TGF-beta inhibitor comprises a TGFBR1 polypeptide (e.g., an extracellular domain of TGFBR1 or functional variant thereof) and a TGFBR3 polypeptide (e.g., an extracellular domain of TGFBR3 or functional variant thereof). In some embodiments, the TGF-beta inhibitor comprises a TGFBR2 polypeptide (e.g., an extracellular domain of TGFBR2 or functional variant thereof) and a TGFBR3 polypeptide (e.g., an extracellular domain of TGFBR3 or functional variant thereof).

Exemplary TGF-beta receptor polypeptides that can be used as TGF-beta inhibitors have been disclosed in U.S. Pat. Nos. 8,993,524, 9,676,863, 8,658,135, US20150056199, US20070184052, and WO2017037634, all of which are herein incorporated by reference in their entirety.

In some embodiments, the TGF-beta inhibitor comprises an extracellular domain of TGFBR1 or a sequence substantially identical thereto (e.g., a sequence that is at least 80%, 85%, 90%, or 95% identical thereto). In some embodiments, the TGF-beta inhibitor comprises an extracellular domain of SEQ ID NO: 95, or a sequence substantially identical thereto (e.g., a sequence that is at least 80%, 85%, 90%, or 95% identical thereto). In some embodiments, the TGF-beta inhibitor comprises an extracellular domain of SEQ ID NO: 96, or a sequence substantially identical thereto (e.g., a sequence that is at least 80%, 85%, 90%, or 95% identical thereto). In some embodiments, the TGF-beta inhibitor comprises an extracellular domain of SEQ ID NO: 97, or a sequence substantially identical thereto (e.g., a sequence that is at least 80%, 85%, 90%, or 95% identical thereto). In some embodiments, the TGF-beta inhibitor comprises the amino acid sequence of SEQ ID NO: 104, or a sequence substantially identical thereto (e.g., a sequence that is at least 80%, 85%, 90%, or 95% identical thereto). In some embodiments, the TGF-beta inhibitor comprises the amino acid sequence of SEQ ID NO: 105, or a sequence substantially identical thereto (e.g., a sequence that is at least 80%, 85%, 90%, or 95% identical thereto).

In some embodiments, the TGF-beta inhibitor comprises an extracellular domain of TGFBR2 or a sequence substantially identical thereto (e.g., a sequence that is at least 80%, 85%, 90%, or 95% identical thereto). In some embodiments, the TGF-beta inhibitor comprises an extracellular domain of SEQ ID NO: 98, or a sequence substantially identical thereto (e.g., a sequence that is at least 80%, 85%, 90%, or 95% identical thereto). In some embodiments, the TGF-beta inhibitor comprises an extracellular domain of SEQ ID NO: 99, or a sequence substantially identical thereto (e.g., a sequence that is at least 80%, 85%, 90%, or 95% identical thereto). In some embodiments, the TGF-beta inhibitor comprises the amino acid sequence of SEQ ID NO: 100, or a sequence substantially identical thereto (e.g., a sequence that is at least 80%, 85%, 90%, or 95% identical thereto). In some embodiments, the TGF-beta inhibitor comprises the amino acid sequence of SEQ ID NO: 101, or a sequence substantially identical thereto (e.g., a sequence that is at least 80%, 85%, 90%, or 95% identical thereto). In some embodiments, the TGF-beta inhibitor comprises the amino acid sequence of SEQ ID NO: 102, or a sequence substantially identical thereto (e.g., a sequence that is at least 80%, 85%, 90%, or 95% identical thereto). In some embodiments, the TGF-beta inhibitor comprises the amino acid sequence of SEQ ID NO: 103, or a sequence substantially identical thereto (e.g., a sequence that is at least 80%, 85%, 90%, or 95% identical thereto).

In some embodiments, the TGF-beta inhibitor comprises an extracellular domain of TGFBR3 or a sequence substantially identical thereto (e.g., a sequence that is at least 80%, 85%, 90%, or 95% identical thereto). In some embodiments, the TGF-beta inhibitor comprises an extracellular domain of SEQ ID NO: 106, or a sequence substantially identical thereto (e.g., a sequence that is at least 80%, 85%, 90%, or 95% identical thereto). In some embodiments, the TGF-beta inhibitor comprises an extracellular domain of SEQ ID NO: 107, or a sequence substantially identical thereto (e.g., a sequence that is at least 80%, 85%, 90%, or 95% identical thereto). In some embodiments, the TGF-beta inhibitor comprises the amino acid sequence of SEQ ID NO: 108, or a sequence substantially identical thereto (e.g., a sequence that is at least 80%, 85%, 90%, or 95% identical thereto).

In some embodiments, the TGF-beta inhibitor comprises no more than one TGF-beta receptor extracellular domain. In some embodiments, the TGF-beta inhibitor comprises two or more (e.g., two, three, four, five, or more) TGF-beta receptor extracellular domains, linked together, e.g., via a linker.

TABLE 19

Exemplary amino acid sequences of TGF-beta polypeptides or TGF-beta receptor polypeptides

| SEQ ID NO | Description | Amino acid sequence |
|---|---|---|
| SEQ ID NO: 92 | Immature human TGF-beta 1 (P01137-1) | MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS |
| SEQ ID NO: 117 | Human TGF-beta 1 (P01137-1) | LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS |
| SEQ ID NO: 93 | Immature human TGF-beta 2 (P61812-1) | MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS |
| SEQ ID NO: 118 | Human TGF-beta 2 (P61812-1) | LSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS |
| SEQ ID NO: 94 | Immature human TGF-beta 3 (P10600-1) | MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS |
| SEQ ID NO: 119 | Human TGF-beta 3 (P10600-1) | LSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS |

TABLE 19-continued

| Exemplary amino acid sequences of TGF-beta polypeptides or TGF-beta receptor polypeptides | | |
|---|---|---|
| SEQ ID NO | Description | Amino acid sequence |
| SEQ ID NO: 95 | Immature human TGFBR1 isoform 1 (P36897-1) | MEAAVAAPRPRLLLLVLAAAAAAAAALLPGATALQCFCHLCT KDNFTCVTDGLCFVSVTETTDKVIHNSMCIAEIDLIPRDRPFVC APSSKTGSVTTTYCCNQDHCNKIELPTTVKSSPGLGPVELAAVI AGPVCFVCISLMLMVYICHNRTVIHHRVPNEEDPSLDRPFISEG TTLKDLIYDMTTSGSGSGLPLLVQRTIARTIVLQESIGKGRFGEV WRGKWRGEEVAVKIFSSREERSWFREAEIYQTVMLRHENILGF IAADNKDNGTWTQLWLVSDYHEHGSLFDYLNRYTVTVEGMIK LALSTASGLAHLHMEIVGTQGKPAIAHRDLKSKNILVKKNGTC CIADLGLAVRHDSATDTIDIAPNHRVGTKRYMAPEVLDDSINM KHFESFKRADIYAMGLVFWEIARRCSIGGIHEDYQLPYYDLVPS DPSVEEMRKVVCEQKLRPNIPNRWQSCEALRVMAKIMRECWY ANGAARLTALRIKKTLSQLSQQEGIKM |
| SEQ ID NO: 120 | Human TGFBR1 isoform 1 (P36897-1) | LQCFCHLCTKDNFTCVTDGLCFVSVTETTDKVIHNSMCIAEIDL IPRDRPFVCAPSSKTGSVTTTYCCNQDHCNKIELPTTVKSSPGL GPVELAAVIAGPVCFVCISLMLMVYICHNRTVIHHRVPNEEDPS LDRPFISEGTTLKDLIYDMTTSGSGSGLPLLVQRTIARTIVLQESI GKGRFGEVWRGKWRGEEVAVKIFSSREERSWFREAEIYQTVM LRHENILGFIAADNKDNGTWTQLWLVSDYHEHGSLFDYLNRY TVTVEGMIKLALSTASGLAHLHMEIVGTQGKPAIAHRDLKSKN ILVKKNGTCCIADLGLAVRHDSATDTIDIAPNHRVGTKRYMAP EVLDDSINMKHFESFKRADIYAMGLVFWEIARRCSIGGIHEDYQ LPYYDLVPSDPSVEEMRKVVCEQKLRPNIPNRWQSCEALRVM AKIMRECWYANGAARLTALRIKKTLSQLSQQEGIKM |
| SEQ ID NO: 96 | Immature human TGFBR1 isoform 2 (P36897-2) | MEAAVAAPRPRLLLLVLAAAAAAAAALLPGATALQCFCHLCT KDNFTCVTDGLCFVSVTETTDKVIHNSMCIAEIDLIPRDRPFVC APSSKTGSVTTTYCCNQDHCNKIELPTTGPFSVKSSPGLGPVEL AAVIAGPVCFVCISLMLMVYICHNRTVIHHRVPNEEDPSLDRPF ISEGTTLKDLIYDMTTSGSGSGLPLLVQRTIARTIVLQESIGKGR FGEVWRGKWRGEEVAVKIFSSREERSWFREAEIYQTVMLRHE NILGFIAADNKDNGTWTQLWLVSDYHEHGSLFDYLNRYTVTV EGMIKLALSTASGLAHLHMEIVGTQGKPAIAHRDLKSKNILVK KNGTCCIADLGLAVRHDSATDTIDIAPNHRVGTKRYMAPEVLD DSINMKHFESFKRADIYAMGLVFWEIARRCSIGGIHEDYQLPYY DLVPSDPSVEEMRKVVCEQKLRPNIPNRWQSCEALRVMAKIM RECWYANGAARLTALRIKKTLSQLSQQEGIKM |
| SEQ ID NO: 121 | Human TGFBR1 isoform 2 (P36897-2) | LQCFCHLCTKDNFTCVTDGLCFVSVTETTDKVIHNSMCIAEIDL IPRDRPFVCAPSSKTGSVTTTYCCNQDHCNKIELPTTGPFSVKSS PGLGPVELAAVIAGPVCFVCISLMLMVYICHNRTVIHHRVPNEE DPSLDRPFISEGTTLKDLIYDMTTSGSGSGLPLLVQRTIARTIVL QESIGKGRFGEVWRGKWRGEEVAVKIFSSREERSWFREAEIYQ TVMLRHENILGFIAADNKDNGTWTQLWLVSDYHEHGSLFDYL NRYTVTVEGMIKLALSTASGLAHLHMEIVGTQGKPAIAHRDLK SKNILVKKNGTCCIADLGLAVRHDSATDTIDIAPNHRVGTKRY MAPEVLDDSINMKHFESFKRADIYAMGLVFWEIARRCSIGGIHE DYQLPYYDLVPSDPSVEEMRKVVCEQKLRPNIPNRWQSCEALR VMAKIMRECWYANGAARLTALRIKKTLSQLSQQEGIKM |
| SEQ ID NO: 97 | Immature human TGFBR1 isoform 3 (P36897-3) | MEAAVAAPRPRLLLLVLAAAAAAAAALLPGATALQCFCHLCT KDNFTCVTDGLCFVSVTETTDKVIHNSMCIAEIDLIPRDRPFVC APSSKTGSVTTTYCCNQDHCNKIELPTTGLPLLVQRTIARTIVLQ ESIGKGRFGEVWRGKWRGEEVAVKIFSSREERSWFREAEIYQT VMLRHENILGFIAADNKDNGTWTQLWLVSDYHEHGSLFDYLN RYTVTVEGMIKLALSTASGLAHLHMEIVGTQGKPAIAHRDLKS KNILVKKNGTCCIADLGLAVRHDSATDTIDIAPNHRVGTKRYM APEVLDDSINMKHFESFKRADIYAMGLVFWEIARRCSIGGIHED YQLPYYDLVPSDPSVEEMRKVVCEQKLRPNIPNRWQSCEALRV MAKIMRECWYANGAARLTALRIKKTLSQLSQQEGIKM |
| SEQ ID NO: 122 | Human TGFBR1 isoform 3 (P36897-3) | LQCFCHLCTKDNFTCVTDGLCFVSVTETTDKVIHNSMCIAEIDL IPRDRPFVCAPSSKTGSVTTTYCCNQDHCNKIELPTTGLPLLVQ RTIARTIVLQESIGKGRFGEVWRGKWRGEEVAVKIFSSREERSW FREAEIYQTVMLRHENILGFIAADNKDNGTWTQLWLVSDYHE HGSLFDYLNRYTVTVEGMIKLALSTASGLAHLHMEIVGTQGKP AIAHRDLKSKNILVKKNGTCCIADLGLAVRHDSATDTIDIAPNH RVGTKRYMAPEVLDDSINMKHFESFKRADIYAMGLVFWEIAR RCSIGGIHEDYQLPYYDLVPSDPSVEEMRKVVCEQKLRPNIPNR WQSCEALRVMAKIMRECWYANGAARLTALRIKKTLSQLSQQE GIKM |
| SEQ ID NO: 104 | Human TGFBR1 fragment 1 | LQCFCHLCTKDNFTCVTDGLCFVSVTETTDKVIHNSMCIAEIDL IPRDRPFVCAPSSKTGSVTTTYCCNQDHCNKIELPTTVKSSPGL GPVEL |

TABLE 19-continued

Exemplary amino acid sequences of TGF-beta polypeptides or TGF-beta receptor polypeptides

| SEQ ID NO | Description | Amino acid sequence |
|---|---|---|
| SEQ ID NO: 105 | Human TGFBR1 fragment 2 | ALQCFCHLCTKDNFTCVTDGLCFVSVTETTDKVIHNSMCIAEID LIPRDRPFVCAPSSKTGSVTTTYCCNQDHCNKIEL |
| SEQ ID NO: 98 | Immature human TGFBR2 isoform B (short isoform) (P37173-1) | MGRGLLRGLWPLHIVLWTRIASTIPPHVQKSVNNDMIVTDNNG AVKFPQLCKFCDVRFSTCDNQKSCMSNCSITSICEKPQEVCVAV WRKNDENITLETVCHDPKLPYHDFILEDAASPKCIMKEKKKPG ETFFMCSCSSDECNDNIIFSEEYNTSNPDLLLVIFQVTGISLLPPL GVAISVIIIFYCYRVNRQQKLSSTWETGKTRKLMEFSEHCAIILE DDRSDISSTCANNINHNTELLPIELDTLVGKGRFAEVYKAKLKQ NTSEQFETVAVKIFPYEEYASWKTEKDIFSDINLKHENILQFLTA EERKTELGKQYWLITAFHAKGNLQEYLTRHVISWEDLRKLGSS LARGIAHLHSDHTPCGRPKMPIVHRDLKSSNILVKNDLTCCLCD FGLSLRLDPTLSVDDLANSGQVGTARYMAPEVLESRMNLENV ESFKQTDVYSMALVLWEMTSRCNAVGEVKDYEPPFGSKVREH PCVESMKDNVLRDRGRPEIPSFWLNHQGIQMVCETLTECWDH DPEARLTAQCVAERFSELEHLDRLSGRSCSEEKIPEDGSLNTTK |
| SEQ ID NO: 123 | Human TGFBR2 isoform B (short isoform) (P37173-1) | TIPPHVQKSVNNDMIVTDNNGAVKFPQLCKFCDVRFSTCDNQK SCMSNCSITSICEKPQEVCVAVWRKNDENITLETVCHDPKLPYH DFILEDAASPKCIMKEKKKPGETFFMCSCSSDECNDNIIFSEEYN TSNPDLLLVIFQVTGISLLPPLGVAISVIIIFYCYRVNRQQKLSST WETGKTRKLMEFSEHCAIILEDDRSDISSTCANNINHNTELLPIE LDTLVGKGRFAEVYKAKLKQNTSEQFETVAVKIFPYEEYASW KTEKDIFSDINLKHENILQFLTAEERKTELGKQYWLITAFHAKG NLQEYLTRHVISWEDLRKLGSSLARGIAHLHSDHTPCGRPKMPI VHRDLKSSNILVKNDLTCCLCDFGLSLRLDPTLSVDDLANSGQ VGTARYMAPEVLESRMNLENVESFKQTDVYSMALVLWEMTS RCNAVGEVKDYEPPFGSKVREHPCVESMKDNVLRDRGRPEIPS FWLNHQGIQMVCETLTECWDHDPEARLTAQCVAERFSELEHL DRLSGRSCSEEKIPEDGSLNTTK |
| SEQ ID NO: 99 | Immature human TGFBR2 isoform A (long isoform) (P37173-2) | MGRGLLRGLWPLHIVLWTRIASTIPPHVQKSDVEMEAQKDEIIC PSCNRTAHPLRHINNDMIVTDNNGAVKFPQLCKFCDVRFSTCD NQKSCMSNCSITSICEKPQEVCVAVWRKNDENITLETVCHDPK LPYHDFILEDAASPKCIMKEKKKPGETFFMCSCSSDECNDNIIFS EEYNTSNPDLLLVIFQVTGISLLPPLGVAISVIIIFYCYRVNRQQK LSSTWETGKTRKLMEFSEHCAIILEDDRSDISSTCANNINHNTEL LPIELDTLVGKGRFAEVYKAKLKQNTSEQFETVAVKIFPYEEYA SWKTEKDIFSDINLKHENILQFLTAEERKTELGKQYWLITAFHA KGNLQEYLTRHVISWEDLRKLGSSLARGIAHLHSDHTPCGRPK MPIVHRDLKSSNILVKNDLTCCLCDFGLSLRLDPTLSVDDLANS GQVGTARYMAPEVLESRMNLENVESFKQTDVYSMALVLWEM TSRCNAVGEVKDYEPPFGSKVREHPCVESMKDNVLRDRGRPEI PSFWLNHQGIQMVCETLTECWDHDPEARLTAQCVAERFSELE HLDRLSGRSCSEEKIPEDGSLNTTK |
| SEQ ID NO: 124 | Human TGFBR2 isoform A (long isoform) (P37173-2) | TIPPHVQKSDVEMEAQKDEIICPSCNRTAHPLRHINNDMIVTDN NGAVKFPQLCKFCDVRFSTCDNQKSCMSNCSITSICEKPQEVCV AVWRKNDENITLETVCHDPKLPYHDFILEDAASPKCIMKEKKK PGETFFMCSCSSDECNDNIIFSEEYNTSNPDLLLVIFQVTGISLLP PLGVAISVIIIFYCYRVNRQQKLSSTWETGKTRKLMEFSEHCAII LEDDRSDISSTCANNINHNTELLPIELDTLVGKGRFAEVYKAKL KQNTSEQFETVAVKIFPYEEYASWKTEKDIFSDINLKHENILQFL TAEERKTELGKQYWLITAFHAKGNLQEYLTRHVISWEDLRKL GSSLARGIAHLHSDHTPCGRPKMPIVHRDLKSSNILVKNDLTCC LCDFGLSLRLDPTLSVDDLANSGQVGTARYMAPEVLESRMNL ENVESFKQTDVYSMALVLWEMTSRCNAVGEVKDYEPPFGSKV REHPCVESMKDNVLRDRGRPEIPSFWLNHQGIQMVCETLTEC WDHDPEARLTAQCVAERFSELEHLDRLSGRSCSEEKIPEDGSLN TTK |
| SEQ ID NO: 100 | Human TGFBR2 fragment 1 (ECD of human TGFBR2 isoform B) | TIPPHVQKSVNNDMIVTDNNGAVKFPQLCKFCDVRFSTCDNQK SCMSNCSITSICEKPQEVCVAVWRKNDENITLETVCHDPKLPYH DFILEDAASPKCIMKEKKKPGETFFMCSCSSDECNDNIIFSEEYN TSNPD |
| SEQ ID NO: 101 | Human TGFBR2 fragment 2 | IPPHVQKSVNNDMIVTDNNGAVKFPQLCKFCDVRFSTCDNQKS CMSNCSITSICEKPQEVCVAVWRKNDENITLETVCHDPKLPYH DFILEDAASPKCIMKEKKKPGETFFMCSCSSDECNDNIIFSEEYN TSNPD |

TABLE 19-continued

Exemplary amino acid sequences of TGF-beta polypeptides or TGF-beta receptor polypeptides

| SEQ ID NO | Description | Amino acid sequence |
|---|---|---|
| SEQ ID NO: 102 | Human TGFBR2 fragment 3 (ECD of human TGFBR2 isoform A) | TIPPHVQKSDVEMEAQKDEIICPSCNRTAHPLRHINNDMIVTDN NGAVKFPQLCKFCDVRFSTCDNQKSCMSNCSITSICEKPQEVCV AVWRKNDENITLETVCHDPKLPYHDFILEDAASPKCIMKEKKK PGETFFMCSCSSDECNDNIIFSEEYNTSNPD |
| SEQ ID NO: 103 | Human TGFBR2 fragment 4 | QLCKFCDVRFSTCDNQKSCMSNCSITSICEKPQEVCVAVWRKN DENITLETVCHDPKLPYHDFILEDAASPKCIMKEKKKPGETFFM CSCSSDECNDNIIF |
| SEQ ID NO: 106 | Immature human TGFBR3 isoform 1 (Q03167-1) | MTSHYVIAIFALMSSCLATAGPEPGALCELSPVSASHPVQALME SFTVLSGCASRGTTGLPQEVHVLNLRTAGQGPGQLQREVTLHL NPISSVHIHHKSVVFLLNSPHPLVWHLKTERLATGVSRLFLVSE GSVVQFSSANFSLTAETEERNFPHGNEHLLNWARKEYGAVTSF TELKIARNIYIKVGEDQVFPPKCNIGKNFLSLNYLAEYLQPKAA EGCVMSSQPQNEEVHIIELITPNSNPYSAFQVDITIDIRPSQEDLE VVKNLILILKCKKSVNWVIKSFDVKGSLKIIAPNSIGFGKESERS MTMTKSIRDDIPSTQGNLVKWALDNGYSPITSYTMAPVANRFH LRLENNAEEMGDEEVHTIPPELRILLDPGALPALQNPPIRGGEG QNGGLPFPFPDISRRVWNEEGEDGLPRPKDPVIPSIQLFPGLREP EEVQGSVDIALSVKCDNEKMIVAVEKDSFQASGYSGMDVTLL DPTCKAKMNGTHFVLESPLNGCGTRPRWSALDGVVYYNSIVIQ VPALGDSSGWPDGYEDLESGDNGFPGDMDEGDASLFTRPEIVV FNCSLQQVRNPSSFQEQPHGNITFNMELYNTDLFLVPSQGVFSV PENGHVYVEVSVTKAEQELGFAIQTCFISPYSNPDRMSHYTIIEN ICPKDESVKFYSPKRVHFPIPQADMDKKRFSFVFKPVFNTSLLFL QCELTLCTKMEKHPQKLPKCVPPDEACTSLDASIIWAMMQNK KTFTKPLAVIHHEAESKEKGPSMKEPNPISPPIFHGLDTLTVMGI AFAAFVIGALLTGALWYIYSHTGETAGRQQVPTSPPASENSSAA HSIGSTQSTPCSSSSTA |
| SEQ ID NO: 125 | Human TGFBR3 isoform 1 (Q03167-1) | GPEPGALCELSPVSASHPVQALMESFTVLSGCASRGTTGLPQEV HVLNLRTAGQGPGQLQREVTLHLNPISSVHIHHKSVVFLLNSPH PLVWHLKTERLATGVSRLFLVSEGSVVQFSSANFSLTAETEERN FPHGNEHLLNWARKEYGAVTSFTELKIARNIYIKVGEDQVFPP KCNIGKNFLSLNYLAEYLQPKAAEGCVMSSQPQNEEVHIIELIT PNSNPYSAFQVDITIDIRPSQEDLEVVKNLILILKCKKSVNWVIK SFDVKGSLKIIAPNSIGFGKESERSMTMTKSIRDDIPSTQGNLVK WALDNGYSPITSYTMAPVANRFHLRLENNAEEMGDEEVHTIPP ELRILLDPGALPALQNPPIRGGEGQNGGLPFPFPDISRRVWNEE GEDGLPRPKDPVIPSIQLFPGLREPEEVQGSVDIALSVKCDNEK MIVAVEKDSFQASGYSGMDVTLLDPTCKAKMNGTHFVLESPL NGCGTRPRWSALDGVVYYNSIVIQVPALGDSSGWPDGYEDLE SGDNGFPGDMDEGDASLFTRPEIVVFNCSLQQVRNPSSFQEQP HGNITFNMELYNTDLFLVPSQGVFSVPENGHVYVEVSVTKAEQ ELGFAIQTCFISPYSNPDRMSHYTIIENICPKDESVKFYSPKRVHF PIPQADMDKKRFSFVFKPVFNTSLLFLQCELTLCTKMEKHPQKL PKCVPPDEACTSLDASIIWAMMQNKKTFTKPLAVIHHEAESKE KGPSMKEPNPISPPIFHGLDTLTVMGIAFAAFVIGALLTGALWYI YSHTGETAGRQQVPTSPPASENSSAAHSIGSTQSTPCSSSSTA |
| SEQ ID NO: 107 | Immature human TGFBR3 isoform 2 (Q03167-2) | MTSHYVIAIFALMSSCLATAGPEPGALCELSPVSASHPVQALME SFTVLSGCASRGTTGLPQEVHVLNLRTAGQGPGQLQREVTLHL NPISSVHIHHKSVVFLLNSPHPLVWHLKTERLATGVSRLFLVSE GSVVQFSSANFSLTAETEERNFPHGNEHLLNWARKEYGAVTSF TELKIARNIYIKVGEDQVFPPKCNIGKNFLSLNYLAEYLQPKAA EGCVMSSQPQNEEVHIIELITPNSNPYSAFQVDITIDIRPSQEDLE VVKNLILILKCKKSVNWVIKSFDVKGSLKIIAPNSIGFGKESERS MTMTKSIRDDIPSTQGNLVKWALDNGYSPITSYTMAPVANRFH LRLENNEEMGDEEVHTIPPELRILLDPGALPALQNPPIRGGEGQ NGGLPFPFPDISRRVWNEEGEDGLPRPKDPVIPSIQLFPGLREPE EVQGSVDIALSVKCDNEKMIVAVEKDSFQASGYSGMDVTLLD PTCKAKMNGTHFVLESPLNGCGTRPRWSALDGVVYYNSIVIQV PALGDSSGWPDGYEDLESGDNGFPGDMDEGDASLFTRPEIVVF NCSLQQVRNPSSFQEQPHGNITFNMELYNTDLFLVPSQGVFSVP ENGHVYVEVSVTKAEQELGFAIQTCFISPYSNPDRMSHYTIIENI CPKDESVKFYSPKRVHFPIPQADMDKKRFSFVFKPVFNTSLLFL QCELTLCTKMEKHPQKLPKCVPPDEACTSLDASIIWAMMQNK KTFTKPLAVIHHEAESKEKGPSMKEPNPISPPIFHGLDTLTVMGI AFAAFVIGALLTGALWYIYSHTGETAGRQQVPTSPPASENSSAA HSIGSTQSTPCSSSSTA |

TABLE 19-continued

Exemplary amino acid sequences of TGF-beta polypeptides or TGF-beta receptor polypeptides

| SEQ ID NO | Description | Amino acid sequence |
|---|---|---|
| SEQ ID NO: 126 | Human TGFBR3 isoform 2 (Q03167-2) | GPEPGALCELSPVSASHPVQALMESFTVLSGCASRGTTGLPQEV HVLNLRTAGQGPGQLQREVTLHLNPISSVHIHHKSVVFLLNSPH PLVWHLKTERLATGVSRLFLVSEGSVVQFSSANFSLTAETEERN FPHGNEHLLNWARKEYGAVTSFTELKIARNIYIKVGEDQVFPP KCNIGKNFLSLNYLAEYLQPKAAEGCVMSSQPQNEEVHIIELIT PNSNPYSAFQVDITIDIRPSQEDLEVVKNLILILKCKKSVNWVIK SFDVKGSLKIIAPNSIGFGKESERSMTMTKSIRDDIPSTQGNLVK WALDNGYSPITSYTMAPVANRFHLRLENNEEMGDEEVHTIPPE LRILLDPGALPALQNPPIRGGEGQNGGLPFPFPDISRRVWNEEG EDGLPRPKDPVIPSIQLFPGLREPEEVQGSVDIALSVKCDNEKMI VAVEKDSFQASGYSGMDVTLLDPTCKAKMNGTHFVLESPLNG CGTRPRWSALDGVVYYNSIVIQVPALGDSSGWPDGYEDLESG DNGFPGDMDEGDASLFTRPEIVVFNCSLQQVRNPSSFQEQPHG NITFNMELYNTDLFLVPSQGVFSVPENGHVYVEVSVTKAEQEL GFAIQTCFISPYSNPDRMSHYTIIENICPKDESVKFYSPKRVHFPI PQADMDKKRFSFVFKPVFNTSLLFLQCELTLCTKMEKHPQKLP KCVPPDEACTSLDASIIWAMMQNKKTFTKPLAVIHHEAESKEK GPSMKEPNPISPPIFHGLDTLTVMGIAFAAFVIGALLTGALWYIY SHTGETAGRQQVPTSPPASENSSAAHSIGSTQSTPCSSSSTA |
| SEQ ID NO: 108 | Human TGFBR3 fragment 1 | GPEPGALCELSPVSASHPVQALMESFTVLSGCASRGTTGLPQEV HVLNLRTAGQGPGQLQREVTLHLNPISSVHIHHKSVVFLLNSPH PLVWHLKTERLATGVSRLFLVSEGSVVQFSSANFSLTAETEERN FPHGNEHLLNWARKEYGAVTSFTELKIARNIYIKVGEDQVFPP KCNIGKNFLSLNYLAEYLQPKAAEGCVMSSQPQNEEVHIIELIT PNSNPYSAFQVDITIDIRPSQEDLEVVKNLILILKCKKSVNWVIK SFDVKGSLKIIAPNSIGFGKESERSMTMTKSIRDDIPSTQGNLVK WALDNGYSPITSYTMAPVANRFHLRLENNAEEMGDEEVHTIPP ELRILLDPGALPALQNPPIRGGEGQNGGLPFPFPDISRRVWNEE GEDGLPRPKDPVIPSIQLFPGLREPEEVQGSVDIALSVKCDNEK MIVAVEKDSFQASGYSGMDVTLLDPTCKAKMNGTHFVLESPL NGCGTRPRWSALDGVVYYNSIVIQVPALGDSSGWPDGYEDLE SGDNGFPGDMDEGDASLFTRPEIVVFNCSLQQVRNPSSFQEQP HGNITFNMELYNTDLFLVPSQGVFSVPENGHVYVEVSVTKAEQ ELGFAIQTCFISPYSNPDRMSHYTIIENICPKDESVKFYSPKRVHF PIPQADMDKKRFSFVFKPVFNTSLLFLQCELTLCTKMEKHPQKL PKCVPPDEACTSLDASIIWAMMQNKKTFTKPLAVIHHEAESKE KGPSMKEPNPISPPIFHGLDTLTV |
| SEQ ID NO: 192 | hCH1-hFc_Hole-3x4GS-TGFBR2 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKRVEPKSCDKTHTCPPCPAPELLGGPSVFLFPPKPK DTLMISRTPEVTCVVVDVSHEDPEVKFNWYVDGVEVHNAKTK PREEQYNSTYRVVSVLTVLHQDWLNGKEYKCKVSNKALPAPI EKTISKAKGQPREPQVCTLPPSREEMTKNQVSLSCAVKGFYPSD IAVEWESNGQPENNYKTTPPVLDSDGSFFLVSKLTVDKSRWQQ GNVFSCSVMHEALHNHYTQKSLSLSPGXGGGGSGGGGSGGGG SIPPHVQKSVNNDMIVTDNNGAVKFPQLCKFCDVRFSTCDNQK SCMSNCSITSICEKPQEVCVAVWRKNDENITLETVCHDPKLPYH DFILEDAASPKCIMKEKKKPGETFFMCSCSSDECNDNIIFSEEYN TSNPD, wherein X is K or absent |
| SEQ ID NO: 193 | hCH1-hFc_Knob-3x4GS-TGFBR2 | ASTKGPSVFPLAPSSKSTSGGTAALGCLVKDYFPEPVTVSWNS GALTSGVHTFPAVLQSSGLYSLSSVVTVPSSSLGTQTYICNVNH KPSNTKVDKRVEPKSCDKTHTCPPCPAPELLGGPSVFLFPPKPK DTLMISRTPEVTCVVVDVSHEDPEVKFNWYVDGVEVHNAKTK PREEQYNSTYRVVSVLTVLHQDWLNGKEYKCKVSNKALPAPI EKTISKAKGQPREPQVYTLPPCREEMTKNQVSLWCLVKGFYPS DIAVEWESNGQPENNYKTTPPVLDSDGSFFLYSKLTVDKSRWQ QGNVFSCSVMHEALHNHYTQKSLSLSPGXGGGGSGGGGSGGG GSIPPHVQKSVNNDMIVTDNNGAVKFPQLCKFCDVRFSTCDNQ KSCMSNCSITSICEKPQEVCVAVWRKNDENITLETVCHDPKLPY HDFILEDAASPKCIMKEKKKPGETFFMCSCSSDECNDNIIFSEEY NTSNPD, wherein X is K or absent |
| SEQ ID NO: 194 | hFc_Hole-3x4GS-TGFBR2 | DKTHTCPPCPAPELLGGPSVFLFPPKPKDTLMISRTPEVTCVVV DVSHEDPEVKFNWYVDGVEVHNAKTKPREEQYNSTYRVVSV LTVLHQDWLNGKEYKCKVSNKALPAPIEKTISKAKGQPREPQV CTLPPSREEMTKNQVSLSCAVKGFYPSDIAVEWESNGQPENNY KTTPPVLDSDGSFFLVSKLTVDKSRWQQGNVFSCSVMHEALH NHYTQKSLSLSPGXGGGGSGGGGSGGGGSIPPHVQKSVNNDMI |

TABLE 19-continued

Exemplary amino acid sequences of TGF-beta polypeptides or TGF-beta receptor polypeptides

| SEQ ID NO | Description | Amino acid sequence |
|---|---|---|
| | | VTDNNGAVKFPQLCKFCDVRFSTCDNQKSCMSNCSITSICEKP QEVCVAVWRKNDENITLETVCHDPKLPYHDFILEDAASPKCIM KEKKKPGETFFMCSCSSDECNDNIIFSEEYNTSNPD, wherein X is K or absent |
| SEQ ID NO: 195 | hFc_Knob-3x4GS-TGFBR2 | DKTHTCPPCPAPELLGGPSVFLFPPKPKDTLMISRTPEVTCVVV DVSHEDPEVKFNWYVDGVEVHNAKTKPREEQYNSTYRVVSV LTVLHQDWLNGKEYKCKVSNKALPAPIEKTISKAKGQPREPQV YTLPPCREEMTKNQVSLWCLVKGFYPSDIAVEWESNGQPENN YKTTPPVLDSDGSFFLYSKLTVDKSRWQQGNVFSCSVMHEAL HNHYTQKSLSLSPGXGGGGSGGGGSGGGGSIPPHVQKSVNND MIVTDNNGAVKFPQLCKFCDVRFSTCDNQKSCMSNCSITSICEK PQEVCVAVWRKNDENITLETVCHDPKLPYHDFILEDAASPKCI MKEKKKPGETFFMCSCSSDECNDNIIFSEEYNTSNPD, wherein X is K or absent |
| SEQ ID NO: 196 | TGFBR2-3x4GS-hCH1-hFc_Hole | IPPHVQKSVNNDMIVTDNNGAVKFPQLCKFCDVRFSTCDNQKS CMSNCSITSICEKPQEVCVAVWRKNDENITLETVCHDPKLPYH DFILEDAASPKCIMKEKKKPGETFFMCSCSSDECNDNIIFSEEYN TSNPDGGGGSGGGGSGGGGSASTKGPSVFPLAPSSKSTSGGTA ALGCLVKDYFPEPVTVSWNSGALTSGVHTFPAVLQSSGLYSLS SVVTVPSSSLGTQTYICNVNHKPSNTKVDKRVEPKSCDKTHTC PPCPAPELLGGPSVFLFPPKPKDTLMISRTPEVTCVVVDVSHEDP EVKFNWYVDGVEVHNAKTKPREEQYNSTYRVVSVLTVLHQD WLNGKEYKCKVSNKALPAPIEKTISKAKGQPREPQVCTLPPSRE EMTKNQVSLSCAVKGFYPSDIAVEWESNGQPENNYKTTPPVLD SDGSFFLVSKLTVDKSRWQQGNVFSCSVMHEALHNHYTQKSL SLSPGX, wherein X is K or absent |
| SEQ ID NO: 197 | TGFBR2-3x4GS-hCH1-hFc_Knob | IPPHVQKSVNNDMIVTDNNGAVKFPQLCKFCDVRFSTCDNQKS CMSNCSITSICEKPQEVCVAVWRKNDENITLETVCHDPKLPYH DFILEDAASPKCIMKEKKKPGETFFMCSCSSDECNDNIIFSEEYN TSNPDGGGGSGGGGSGGGGSASTKGPSVFPLAPSSKSTSGGTA ALGCLVKDYFPEPVTVSWNSGALTSGVHTFPAVLQSSGLYSLS SVVTVPSSSLGTQTYICNVNHKPSNTKVDKRVEPKSCDKTHTC PPCPAPELLGGPSVFLFPPKPKDTLMISRTPEVTCVVVDVSHEDP EVKFNWYVDGVEVHNAKTKPREEQYNSTYRVVSVLTVLHQD WLNGKEYKCKVSNKALPAPIEKTISKAKGQPREPQVYTLPPCR EEMTKNQVSLWCLVKGFYPSDIAVEWESNGQPENNYKTTPPV LDSDGSFFLYSKLTVDKSRWQQGNVFSCSVMHEALHNHYTQK SLSLSPGX, wherein X is K or absent |
| SEQ ID NO: 198 | TGFBR2-3x4GS-hCLIg_vl | IPPHVQKSVNNDMIVTDNNGAVKFPQLCKFCDVRFSTCDNQKS CMSNCSITSICEKPQEVCVAVWRKNDENITLETVCHDPKLPYH DFILEDAASPKCIMKEKKKPGETFFMCSCSSDECNDNIIFSEEYN TSNPDGGGGSGGGGSGGGGSGQPKANPTVTLFPPSSEELQANK ATLVCLISDFYPGAVTVAWKADGSPVKAGVETTKPSKQSNNK YAASSYLSLTPEQWKSHRSYSCQVTHEGSTVEKTVAPTECS |
| SEQ ID NO: 199 | TGFBR2-3x4GS-hCLIg_vk | IPPHVQKSVNNDMIVTDNNGAVKFPQLCKFCDVRFSTCDNQKS CMSNCSITSICEKPQEVCVAVWRKNDENITLETVCHDPKLPYH DFILEDAASPKCIMKEKKKPGETFFMCSCSSDECNDNIIFSEEYN TSNPDGGGGSGGGGSGGGGSRTVAAPSVFIFPPSDEQLKSGTAS VVCLLNNFYPREAKVQWKVDNALQSGNSQESVTEQDSKDSTY SLSSTLTLSKADYEKHKVYACEVTHQGLSSPVTKSFNRGEC |

Immune Cell Engagers

The immune cell engagers of the multispecific or multifunctional molecules disclosed herein can mediate binding to, and/or activation of, an immune cell, e.g., an immune effector cell. In some embodiments, the immune cell is chosen from a T cell, an NK cell, a B cell, a dendritic cell, or a macrophage cell engager, or a combination thereof. In some embodiments, the immune cell engager is chosen from one, two, three, or all of a T cell engager, NK cell engager, a B cell engager, a dendritic cell engager, or a macrophage cell engager, or a combination thereof. The immune cell engager can be an agonist of the immune system. In some embodiments, the immune cell engager can be an antibody molecule, a ligand molecule (e.g., a ligand that further comprises an immunoglobulin constant region, e.g., an Fc region), a small molecule, a nucleotide molecule.

Natural Killer Cell Engagers

Natural Killer (NK) cells recognize and destroy tumors and virus-infected cells in an antibody-independent manner. The regulation of NK cells is mediated by activating and inhibiting receptors on the NK cell surface. One family of activating receptors is the natural cytotoxicity receptors (NCRs) which include NKp30, NKp44 and NKp46. The NCRs initiate tumor targeting by recognition of heparan sulfate on cancer cells. NKG2D is a receptor that provides both stimulatory and costimulatory innate immune responses on activated killer (NK) cells, leading to cytotoxic activity. DNAM1 is a receptor involved in intercellular adhesion, lymphocyte signaling, cytotoxicity and lymphokine secretion mediated by cytotoxic T-lymphocyte (CTL) and NK cell. DAP10 (also known as HCST) is a transmembrane adapter protein which associates with KLRK1 to form an activation receptor KLRK1-HCST in lymphoid and myeloid cells; this receptor plays a major role in triggering cytotoxicity against target cells expressing cell surface ligands such as MHC class I chain-related MICA and MICB, and U(optionally L1)6-binding proteins (ULBPs); it KLRK1-HCST receptor plays a role in immune surveillance against tumors and is required for cytolysis of tumors cells; indeed, melanoma cells that do not express KLRK1 ligands escape from immune surveillance mediated by NK cells. CD16 is a receptor for the Fc region of IgG, which binds complexed or aggregated IgG and also monomeric IgG and thereby mediates antibody-dependent cellular cytotoxicity (ADCC) and other antibody-dependent responses, such as phagocytosis.

The present disclosure provides, inter alia, multispecific (e.g., bi-, tri-, quad-specific) or multifunctional molecules, that are engineered to contain one or more NK cell engagers that mediate binding to and/or activation of an NK cell. Accordingly, in some embodiments, the NK cell engager is selected from an antigen binding domain or ligand that binds to (e.g., activates): NKp30, NKp40, NKp44, NKp46, NKG2D, DNAM1, DAP10, CD16 (e.g., CD16a, CD16b, or both), CRTAM, CD27, PSGL1, CD96, CD100 (SEMA4D), NKp80, CD244 (also known as SLAMF4 or 2B4), SLAMF6, SLAMF7, KIR2DS2, KIR2DS4, KIR3DS1, KIR2DS3, KIR2DS5, KIR2DS1, CD94, NKG2C, NKG2E, or CD160.

In some embodiments, the NK cell engager is an antigen binding domain that binds to NKp30 (e.g., NKp30 present, e.g., expressed or displayed, on the surface of an NK cell) and comprises any CDR amino acid sequence, framework region (FWR) amino acid sequence, or variable region amino acid sequence disclosed in Table 20A or Table 20B, Table 22, Table 23A or Table 23B, Table 24, Table 25, Table 26, Table 21A or Table 21B, and Table 17. In some embodiments, the NK cell engager is an antigen binding domain that binds to NKp30 (e.g., NKp30 present, e.g., expressed or displayed, on the surface of an NK cell) and comprises any CDR amino acid sequence, framework region (FWR) amino acid sequence, or variable region amino acid sequence disclosed in U.S. Pat. Nos. 6,979,546, 9,447,185, PCT Application No. WO2015121383A1, PCT Application No. WO2016110468A1, PCT Application No. WO2004056392A1, or U.S. Application Publication No. US20070231322A1, the sequences of which are hereby incorporated by reference. In some embodiments, binding of the NK cell engager, e.g., antigen binding domain that binds to NKp30, to the NK cell activates the NK cell. An antigen binding domain that binds to NKp30 (e.g., NKp30 present, e.g., expressed or displayed, on the surface of an NK cell) may be said to target NKp30, the NK cell, or both.

In some embodiments, the antigen binding domain that binds to NKp30 comprises one or more CDRs (e.g., VHCDR1, VHCDR2, VHCDR3, VLCDR1, VLCDR2, and/or VLCDR3) disclosed in Table 20A or Table 20B, Table 21A or Table 21B, or Table 22, or a sequence having at least 85%, 90%, 95%, or 99% identity thereto. In some embodiments, the antigen binding domain that binds to NKp30 comprises one or more framework regions (e.g., VHFWR1, VHFWR2, VHFWR3, VHFWR4, VLFWR1, VLFWR2, VLFWR3, and/or VLFWR4) disclosed in Table 20A or Table 20B, Table 21A or Table 21B, or Table 22, or a sequence having at least 85%, 90%, 95%, or 99% identity thereto. In some embodiments, the antigen binding domain that binds to NKp30 comprises a VH and/or a VL disclosed in Table 25, or a sequence having at least 85%, 90%, 95%, or 99% identity thereto. In some embodiments, the antigen binding domain that binds to NKp30 comprises an amino acid sequence disclosed in Table 26, or a sequence having at least 85%, 90%, 95%, or 99% identity thereto.

In some embodiments, the antigen binding domain that binds to NKP30 comprises one or more CDRs (e.g., VHCDR1, VHCDR2, VHCDR3, VLCDR1, VLCDR2, and/or VLCDR3) disclosed in Table 23 and/or Table 24, or a sequence having at least 85%, 90%, 95%, or 99% identity thereto. In some embodiments, the antigen binding domain that binds to NKP30 comprises one or more framework regions (e.g., VHFWR1, VHFWR2, VHFWR3, VHFWR4, VLFWR1, VLFWR2, VLFWR3, and/or VLFWR4) disclosed in Table 23 and/or Table 24, or a sequence having at least 85%, 90%, 95%, or 99% identity thereto. In some embodiments, the antigen binding domain that binds to NKP30 comprises a VH and/or a VL disclosed in Table 25, or a sequence having at least 85%, 90%, 95%, or 99% identity thereto.

In some embodiments, the antigen binding domain that binds to NKp30 comprises a VH comprising a heavy chain complementarity determining region 1 (VHCDR1), a VHCDR2, and a VHCDR3, and a VL comprising a light chain complementarity determining region 1 (VLCDR1), a VLCDR2, and a VLCDR3.

In some embodiments, the VHCDR1, VHCDR2, and VHCDR3 comprise the amino acid sequences of SEQ ID NOs: 7313, 6001, and 7315, respectively (or a sequence having at least 85%, 90%, 95%, or 99% identity thereto). In some embodiments, the VHCDR1, VHCDR2, and VHCDR3 comprise the amino acid sequences of SEQ ID NOs: 7313, 6001, and 6002, respectively (or a sequence having at least 85%, 90%, 95%, or 99% identity thereto). In some embodiments, the VHCDR1, VHCDR2, and VHCDR3 comprise the amino acid sequences of SEQ ID NOs: 7313, 6008, and 6009, respectively (or a sequence having at least 85%, 90%, 95%, or 99% identity thereto). In some embodiments, the VHCDR1, VHCDR2, and VHCDR3 comprise the amino acid sequences of SEQ ID NOs: 7313, 7385, and 7315, respectively (or a sequence having at least 85%, 90%, 95%, or 99% identity thereto). In some embodiments, the VHCDR1, VHCDR2, and VHCDR3 comprise the amino acid sequences of SEQ ID NOs: 7313, 7318, and 6009, respectively (or a sequence having at least 85%, 90%, 95%, or 99% identity thereto). In some embodiments, the VHCDR1, VHCDR2, and VHCDR3 comprise the amino acid sequences of SEQ ID NOs: 8053, 6001, and 7315, respectively (or a sequence having at least 85%, 90%, 95%, or 99% identity thereto). In some embodiments, the VHCDR1, VHCDR2, and VHCDR3 comprise the amino acid sequences of SEQ ID NOs: 8053, 6001, and 7315, respectively (or a sequence having at least 85%, 90%, 95%, or 99% identity thereto). In some embodiments, the VHCDR1, VHCDR2, and VHCDR3 comprise the amino acid sequences of SEQ ID NOs: 8053, 6001, and 7315, respectively (or a sequence having at least 85%, 90%, 95%, or 99% identity thereto). In some embodiments, the VHCDR1, VHCDR2, and VHCDR3 comprise the amino acid sequences of SEQ ID NOs: 8053, 6001, and 7315, respectively (or a sequence having at least 85%, 90%, 95%, or 99% identity thereto). In some embodiments, the VHCDR1, VHCDR2, and VHCDR3 comprise the amino acid sequences of SEQ ID NOs: 8053, 8688, and 7315, respectively (or a sequence having at least 85%, 90%, 95%, or 99% identity thereto). In some embodiments, the VHCDR1, VHCDR2, and VHCDR3 comprise the amino acid sequences of SEQ ID NOs: 8053, 8688, and 7315, respectively (or a sequence having at least 85%, 90%, 95%, or 99% identity thereto). In some embodiments, the VHCDR1, VHCDR2, and VHCDR3 comprise the amino acid sequences of SEQ ID NOs: 8053, 8688, and 7315, respectively (or a sequence having at least 85%, 90%, 95%, or 99% identity thereto). In some embodiments, the VHCDR1, VHCDR2, and VHCDR3 comprise the amino acid sequences of SEQ ID NOs: 8053, 8688, and 7315, respectively (or a sequence having at least 85%, 90%, 95%, or 99% identity thereto).

In some embodiments, the VLCDR1, VLCDR2, and VLCDR3 comprise the amino acid sequences of SEQ ID NOs: 7326, 7327, and 7329, respectively (or a sequence having at least 85%, 90%, 95%, or 99% identity thereto). In some embodiments, the VLCDR1, VLCDR2, and VLCDR3 comprise the amino acid sequences of SEQ ID NOs: 6063, 6064, and 7293, respectively (or a sequence having at least 85%, 90%, 95%, or 99% identity thereto). In some embodiments, the VLCDR1, VLCDR2, and VLCDR3 comprise the amino acid sequences of SEQ ID NOs: 6070, 6071, and 6072, respectively (or a sequence having at least 85%, 90%, 95%, or 99% identity thereto). In some embodiments, the VLCDR1, VLCDR2, and VLCDR3 comprise the amino acid sequences of SEQ ID NOs: 6070, 6064, and 7321, respectively (or a sequence having at least 85%, 90%, 95%, or 99% identity thereto).

In some embodiments, the VHCDR1, VHCDR2, VHCDR3, VLCDR1, VLCDR2, and VLCDR3 comprise the amino acid sequences of SEQ ID NOs: 7313, 6001, 7315, 7326, 7327, and 7329, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 7313, 6001, 6002, 6063, 6064, and 7293, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 7313, 6008, 6009, 6070, 6071, and 6072, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 7313, 7385, 7315, 6070, 6064, and 7321, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 7313, 7318, 6009, 6070, 6064, and 7321, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 8053, 6001, 7315, 7326, 7327, and 8689, respectively (or a sequence having at least 85%, 90%, 95%, or 99% identity thereto) In some embodiments, the VHCDR1, VHCDR2, VHCDR3, VLCDR1, VLCDR2, and VLCDR3 comprise the amino acid sequences of SEQ ID NOs: 8053, 6001, 7315, 7326, 7327, and 8690, respectively (or a sequence having at least 85%, 90%, 95%, or 99% identity thereto) In some embodiments, the VHCDR1, VHCDR2, VHCDR3, VLCDR1, VLCDR2, and VLCDR3 comprise the amino acid sequences of SEQ ID NOs: 8053, 6001, 7315, 7326, 7327, and 8690, respectively (or a sequence having at least 85%, 90%, 95%, or 99% identity thereto) In some embodiments, the VHCDR1, VHCDR2, VHCDR3, VLCDR1, VLCDR2, and VLCDR3 comprise the amino acid sequences of SEQ ID NOs: 8053, 6001, 7315, 7326, 7327, and 8689, respectively (or a sequence having at least 85%, 90%, 95%, or 99% identity thereto) In some embodiments, the VHCDR1, VHCDR2, VHCDR3, VLCDR1, VLCDR2, and VLCDR3 comprise the amino acid sequences of SEQ ID NOs: 8053, 8688, 7315, 7326, 7327, and 7329, respectively (or a sequence having at least 85%, 90%, 95%, or 99% identity thereto) In some embodiments, the VHCDR1, VHCDR2, VHCDR3, VLCDR1, VLCDR2, and VLCDR3 comprise the amino acid sequences of SEQ ID NOs: 8053, 8688, 7315, 7326, 7327, and 7329, respectively (or a sequence having at least 85%, 90%, 95%, or 99% identity thereto) In some embodiments, the VHCDR1, VHCDR2, VHCDR3, VLCDR1, VLCDR2, and VLCDR3 comprise the amino acid sequences of SEQ ID NOs: 8053, 8688, 7315, 7326, 7327, and 8691, respectively (or a sequence having at least 85%, 90%, 95%, or 99% identity thereto) In some embodiments, the VHCDR1, VHCDR2, VHCDR3, VLCDR1, VLCDR2, and VLCDR3 comprise the amino acid sequences of SEQ ID NOs: 8053, 8688, 7315, 7326, 7327, and 8691, respectively (or a sequence having at least 85%, 90%, 95%, or 99% identity thereto).

In some embodiments, the VLCDR1, VLCDR2, and VLCDR3 comprise the amino acid sequences of SEQ ID NOs: 7326, 7327, and 8689, respectively (or a sequence having at least 85%, 90%, 95%, or 99% identity thereto). In some embodiments, the VLCDR1, VLCDR2, and VLCDR3 comprise the amino acid sequences of SEQ ID NOs: 7326, 7327, and 8690, respectively (or a sequence having at least 85%, 90%, 95%, or 99% identity thereto). In some embodiments, the VLCDR1, VLCDR2, and VLCDR3 comprise the amino acid sequences of SEQ ID NOs: 7326, 7327, and 8690, respectively (or a sequence having at least 85%, 90%, 95%, or 99% identity thereto). In some embodiments, the VLCDR1, VLCDR2, and VLCDR3 comprise the amino acid sequences of SEQ ID NOs: 7326, 7327, and 8689, respectively (or a sequence having at least 85%, 90%, 95%, or 99% identity thereto). In some embodiments, the VLCDR1, VLCDR2, and VLCDR3 comprise the amino acid sequences of SEQ ID NOs: 7326, 7327, and 7329, respectively (or a sequence having at least 85%, 90%, 95%, or 99% identity thereto). In some embodiments, the VLCDR1, VLCDR2, and VLCDR3 comprise the amino acid sequences of SEQ ID NOs: 7326, 7327, and 7329, respectively (or a sequence having at least 85%, 90%, 95%, or 99% identity thereto). In some embodiments, the VLCDR1, VLCDR2, and VLCDR3 comprise the amino acid sequences of SEQ ID NOs: 7326, 7327, and 8691, respectively (or a sequence having at least 85%, 90%, 95%, or 99% identity thereto). In some embodiments, the VLCDR1, VLCDR2, and VLCDR3 comprise the amino acid sequences of SEQ ID NOs: 7326, 7327, and 8691, respectively (or a sequence having at least 85%, 90%, 95%, or 99% identity thereto).

In some embodiments, the VH comprises an amino acid sequence selected from the group consisting of SEQ ID NOs: 7298 or 7300-7304 (or a sequence having at least 85%, 90%, 95%, or 99% identity thereto) and/or the VL comprises an amino acid sequence selected from the group consisting of SEQ ID NOs: 7299 or 7305-7309 (or a sequence having at least 85%, 90%, 95%, or 99% identity thereto). In some embodiments, the VH and VL comprise the amino acid sequences of SEQ ID NOs: 7302 and 7305, respectively (or a sequence having at least 85%, 90%, 95%, or 99% identity thereto). In some embodiments, the VH and VL comprise the amino acid sequences of SEQ ID NOs: 7302 and 7309, respectively (or a sequence having at least 85%, 90%, 95%, or 99% identity thereto).

In some embodiments, the VH comprises an amino acid sequence selected from the group consisting of SEQ ID NOs: 6121 or 6123-6128 (or a sequence having at least 85%, 90%, 95%, or 99% identity thereto) and/or the VL comprises an amino acid sequence selected from the group consisting of SEQ ID NOs: 7294 or 6137-6141 (or a sequence having at least 85%, 90%, 95%, or 99% identity thereto). In some embodiments, the VH comprises an amino acid sequence selected from the group consisting of SEQ ID NOs: 6122 or 6129-6134 (or a sequence having at least 85%, 90%, 95%, or 99% identity thereto) and/or the VL comprises an amino acid sequence selected from the group consisting of SEQ ID NOs: 6136 or 6142-6147 (or a sequence having at least 85%, 90%, 95%, or 99% identity thereto). In some embodiments, the VH and VL comprise the amino acid sequences of SEQ ID NOs: 7295 and 7296, respectively (or a sequence having at least 85%, 90%, 95%, or 99% identity thereto). In some embodiments, the VH and VL comprise the amino acid sequences of SEQ ID NOs: 7297 and 7296, respectively (or a sequence having at least 85%, 90%, 95%, or 99% identity thereto). In some embodiments, the VH and VL comprise the amino acid sequences of SEQ ID NOs: 6122 and 6136, respectively (or a sequence having at least 85%, 90%, 95%, or 99% identity thereto).

In some embodiments, the antigen binding domain that binds to NKp30 comprises the amino acid sequence of SEQ ID NO: 7310 (or a sequence having at least 85%, 90%, 95%, or 99% identity thereto). In some embodiments, the antigen binding domain that binds to NKp30 comprises the amino acid sequence of SEQ ID NO: 7311 (or a sequence having at least 85%, 90%, 95%, or 99% identity thereto). In some embodiments, the antigen binding domain that binds to NKp30 comprises the amino acid sequence of SEQ ID NO: 6187, 6188, 6189 or 6190 (or a sequence having at least 85%, 90%, 95%, or 99% identity thereto).

In some embodiments, the antigen binding domain that targets NKp30 comprises a VH comprising a heavy chain complementarity determining region 1 (VHCDR1) amino acid sequence of SEQ ID NO: 6000 (or a sequence with no more than 1, 2, 3, or 4 mutations, e.g., substitutions, additions, or deletions), a VHCDR2 amino acid sequence of SEQ ID NO: 6001 (or a sequence with no more than 1, 2, 3, or 4 mutations, e.g., substitutions, additions, or deletions), and/or a VHCDR3 amino acid sequence of SEQ ID NO: 6002 (or a sequence with no more than 1, 2, 3, or 4 mutations, e.g., substitutions, additions, or deletions). In some embodiments, the NKp30 antigen binding domain comprises a VH comprising a VHCDR1 amino acid sequence of SEQ ID NO: 6000, a VHCDR2 amino acid sequence of SEQ ID NO: 6001, and/or a VHCDR3 amino acid sequence of SEQ ID NO: 6002.

In some embodiments, the antigen binding domain that targets NKp30 comprises a VL comprising a light chain complementarity determining region 1 (VLCDR1) amino acid sequence of SEQ ID NO: 6063 (or a sequence with no more than 1, 2, 3, or 4 mutations, e.g., substitutions, additions, or deletions), a VLCDR2 amino acid sequence of SEQ ID NO: 6064 (or a sequence with no more than 1, 2, 3, or 4 mutations, e.g., substitutions, additions, or deletions), and/or a VLCDR3 amino acid sequence of SEQ ID NO: 7293 (or a sequence with no more than 1, 2, 3, or 4 mutations, e.g., substitutions, additions, or deletions). In some embodiments, the antigen binding domain that targets NKp30 comprises a VL comprising a VLCDR1 amino acid sequence of SEQ ID NO: 6063, a VLCDR2 amino acid sequence of SEQ ID NO: 6064, and a VLCDR3 amino acid sequence of SEQ ID NO: 7293.

In some embodiments, the antigen binding domain that targets NKp30 comprises a VH comprising a heavy chain complementarity determining region 1 (VHCDR1) amino acid sequence of SEQ ID NO: 6000 (or a sequence with no more than 1, 2, 3, or 4 mutations, e.g., substitutions, additions, or deletions), a VHCDR2 amino acid sequence of SEQ ID NO: 6001 (or a sequence with no more than 1, 2, 3, or 4 mutations, e.g., substitutions, additions, or deletions), and/or a VHCDR3 amino acid sequence of SEQ ID NO: 6002 (or a sequence with no more than 1, 2, 3, or 4 mutations, e.g., substitutions, additions, or deletions), and a VL comprising a light chain complementarity determining region 1 (VLCDR1) amino acid sequence of SEQ ID NO: 6063 (or a sequence with no more than 1, 2, 3, or 4 mutations, e.g., substitutions, additions, or deletions), a VLCDR2 amino acid sequence of SEQ ID NO: 6064 (or a sequence with no more than 1, 2, 3, or 4 mutations, e.g., substitutions, additions, or deletions), and/or a VLCDR3 amino acid sequence of SEQ ID NO: 7293 (or a sequence with no more than 1, 2, 3, or 4 mutations, e.g., substitutions, additions, or deletions). In some embodiments, the NKp30 antigen binding domain comprises a VH comprising a VHCDR1 amino acid sequence of SEQ ID NO: 6000, a VHCDR2 amino acid sequence of SEQ ID NO: 6001, and/or a VHCDR3 amino acid sequence of SEQ ID NO: 6002, and a VL comprising a VLCDR1 amino acid sequence of SEQ ID NO: 6063, a VLCDR2 amino acid sequence of SEQ ID NO: 6064, and a VLCDR3 amino acid sequence of SEQ ID NO: 7293.

In some embodiments, the antigen binding domain that targets NKp30 comprises a VH comprising a heavy chain complementarity determining region 1 (VHCDR1) amino acid sequence of SEQ ID NO: 6007 (or a sequence with no more than 1, 2, 3, or 4 mutations, e.g., substitutions, additions, or deletions), a VHCDR2 amino acid sequence of SEQ ID NO: 6008 (or a sequence with no more than 1, 2, 3, or 4 mutations, e.g., substitutions, additions, or deletions), and/or a VHCDR3 amino acid sequence of SEQ ID NO: 6009 (or a sequence with no more than 1, 2, 3, or 4 mutations, e.g., substitutions, additions, or deletions). In some embodiments, the NKp30 antigen binding domain comprises a VH comprising a VHCDR1 amino acid sequence of SEQ ID NO: 6007, a VHCDR2 amino acid sequence of SEQ ID NO: 6008, and/or a VHCDR3 amino acid sequence of SEQ ID NO: 6009.

In some embodiments, the antigen binding domain that targets NKp30 comprises a VL comprising a light chain complementarity determining region 1 (VLCDR1) amino acid sequence of SEQ ID NO: 6070 (or a sequence with no more than 1, 2, 3, or 4 mutations, e.g., substitutions, additions, or deletions), a VLCDR2 amino acid sequence of SEQ ID NO: 6071 (or a sequence with no more than 1, 2, 3, or 4 mutations, e.g., substitutions, additions, or deletions), and/or a VLCDR3 amino acid sequence of SEQ ID NO: 6072 (or a sequence with no more than 1, 2, 3, or 4 mutations, e.g., substitutions, additions, or deletions). In some embodiments, the antigen binding domain that targets NKp30 comprises a VL comprising a VLCDR1 amino acid sequence of SEQ ID NO: 6070, a VLCDR2 amino acid sequence of SEQ ID NO: 6071, and a VLCDR3 amino acid sequence of SEQ ID NO: 6072.

In some embodiments, the antigen binding domain that targets NKp30 comprises a VH comprising a heavy chain complementarity determining region 1 (VHCDR1) amino acid sequence of SEQ ID NO: 6007 (or a sequence with no more than 1, 2, 3, or 4 mutations, e.g., substitutions, additions, or deletions), a VHCDR2 amino acid sequence of SEQ ID NO: 6008 (or a sequence with no more than 1, 2, 3, or 4 mutations, e.g., substitutions, additions, or deletions), and/or a VHCDR3 amino acid sequence of SEQ ID NO: 6009 (or a sequence with no more than 1, 2, 3, or 4 mutations, e.g., substitutions, additions, or deletions), and a VL comprising a light chain complementarity determining region 1 (VLCDR1) amino acid sequence of SEQ ID NO: 6070 (or a sequence with no more than 1, 2, 3, or 4 mutations, e.g., substitutions, additions, or deletions), a VLCDR2 amino acid sequence of SEQ ID NO: 6071 (or a sequence with no more than 1, 2, 3, or 4 mutations, e.g., substitutions, additions, or deletions), and/or a VLCDR3 amino acid sequence of SEQ ID NO: 6072 (or a sequence with no more than 1, 2, 3, or 4 mutations, e.g., substitutions, additions, or deletions). In some embodiments, the NKp30 antigen binding domain comprises a VH comprising a VHCDR1 amino acid sequence of SEQ ID NO: 6007, a VHCDR2 amino acid sequence of SEQ ID NO: 6008, and/or a VHCDR3 amino acid sequence of SEQ ID NO: 6009, and a VL comprising a VLCDR1 amino acid sequence of SEQ ID NO: 6070, a VLCDR2 amino acid sequence of SEQ ID NO: 6071, and a VLCDR3 amino acid sequence of SEQ ID NO: 6072.

In some embodiments, the antigen binding domain that targets NKp30 comprises a VH comprising a heavy chain framework region 1 (VHFWR1) amino acid sequence of SEQ ID NO: 6003, a VHFWR2 amino acid sequence of SEQ ID NO: 6004, a VHFWR3 amino acid sequence of SEQ ID NO: 6005, and/or a VHFWR4 amino acid sequence of SEQ ID NO: 6006.

In some embodiments, the antigen binding domain that targets NKp30 comprises a VL comprising a light chain framework region 1 (VLFWR1) amino acid sequence of SEQ ID NO: 6066, a VLFWR2 amino acid sequence of SEQ ID NO: 6067, a VLFWR3 amino acid sequence of SEQ ID NO: 7292, and/or a VLFWR4 amino acid sequence of SEQ ID NO: 6069.

In some embodiments, the antigen binding domain that targets NKp30 comprises a VH comprising a heavy chain framework region 1 (VHFWR1) amino acid sequence of SEQ ID NO: 6003, a VHFWR2 amino acid sequence of SEQ ID NO: 6004, a VHFWR3 amino acid sequence of SEQ ID NO: 6005, and/or a VHFWR4 amino acid sequence of SEQ ID NO: 6006, and a VL comprising a light chain framework region 1 (VLFWR1) amino acid sequence of SEQ ID NO: 6066, a VLFWR2 amino acid sequence of SEQ ID NO: 6067, a VLFWR3 amino acid sequence of SEQ ID NO: 7292, and/or a VLFWR4 amino acid sequence of SEQ ID NO: 6069.

In some embodiments, the antigen binding domain that targets NKp30 comprises a VH comprising a VHFWR1 amino acid sequence of SEQ ID NO: 6003 (or a sequence with no more than 1, 2, 3, 4, 5, or 6 mutations, e.g., substitutions, additions, or deletions, therefrom), a VHFWR2 amino acid sequence of SEQ ID NO: 6004 (or a sequence with no more than 1, 2, 3, 4, 5, or 6 mutations, e.g., substitutions, additions, or deletions, therefrom), a VHFWR3 amino acid sequence of SEQ ID NO: 6005 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6006.

In some embodiments, the antigen binding domain that targets NKp30 comprises a VL comprising a VLFWR1 amino acid sequence of SEQ ID NO: 6066 (or a sequence with no more than 1, 2, or 3 mutations, e.g., substitutions, additions, or deletions), a VLFWR2 amino acid sequence of SEQ ID NO: 6067 (or a sequence with no more than 1 mutation, e.g., substitution, addition, or deletion), a VLFWR3 amino acid sequence of SEQ ID NO: 7292 (or a sequence with no more than 1 mutation, e.g., substitution, addition, or deletion), and/or a VLFWR4 amino acid sequence of SEQ ID NO: 6069.

In some embodiments, the antigen binding domain that targets NKp30 comprises a VH comprising a VHFWR1 amino acid sequence of SEQ ID NO: 6003 (or a sequence with no more than 1, 2, 3, 4, 5, or 6 mutations, e.g., substitutions, additions, or deletions, therefrom), a VHFWR2 amino acid sequence of SEQ ID NO: 6004 (or a sequence with no more than 1, 2, 3, 4, 5, or 6 mutations, e.g., substitutions, additions, or deletions, therefrom), a VHFWR3 amino acid sequence of SEQ ID NO: 6005 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6006, and a VL comprising a VLFWR1 amino acid sequence of SEQ ID NO: 6066 (or a sequence with no more than 1, 2, or 3 mutations, e.g., substitutions, additions, or deletions), a VLFWR2 amino acid sequence of SEQ ID NO: 6067 (or a sequence with no more than 1 mutation, e.g., substitution, addition, or deletion), a VLFWR3 amino acid sequence of SEQ ID NO: 7292 (or a sequence with no more than 1 mutation, e.g., substitution, addition, or deletion), and/or a VLFWR4 amino acid sequence of SEQ ID NO: 6069.

In some embodiments, the antigen binding domain that targets NKp30 comprises a VH comprising a heavy chain framework region 1 (VHFWR1) amino acid sequence of SEQ ID NO: 6010, a VHFWR2 amino acid sequence of SEQ ID NO: 6011, a VHFWR3 amino acid sequence of SEQ ID NO: 6012, and/or a VHFWR4 amino acid sequence of SEQ ID NO: 6013.

In some embodiments, the antigen binding domain that targets NKp30 comprises a VL comprising a light chain framework region 1 (VLFWR1) amino acid sequence of SEQ ID NO: 6073, a VLFWR2 amino acid sequence of SEQ ID NO: 6074, a VLFWR3 amino acid sequence of SEQ ID NO: 6075, and/or a VLFWR4 amino acid sequence of SEQ ID NO: 6076.

In some embodiments, the antigen binding domain that targets NKp30 comprises a VH comprising a heavy chain framework region 1 (VHFWR1) amino acid sequence of SEQ ID NO: 6010, a VHFWR2 amino acid sequence of SEQ ID NO: 6011, a VHFWR3 amino acid sequence of SEQ ID NO: 6012, and/or a VHFWR4 amino acid sequence of SEQ ID NO: 6013, and a VL comprising a light chain framework region 1 (VLFWR1) amino acid sequence of SEQ ID NO: 6073, a VLFWR2 amino acid sequence of SEQ ID NO: 6074, a VLFWR3 amino acid sequence of SEQ ID NO: 6075, and/or a VLFWR4 amino acid sequence of SEQ ID NO: 6076.

In some embodiments, the antigen binding domain that targets NKp30 comprises a VH comprising a VHFWR1 amino acid sequence of SEQ ID NO: 6010 (or a sequence with no more than 1, 2, 3, 4, 5, or 6 mutations, e.g., substitutions, additions, or deletions, therefrom), a VHFWR2 amino acid sequence of SEQ ID NO: 6011 (or a sequence with no more than 1, 2, 3, 4, 5, or 6 mutations, e.g., substitutions, additions, or deletions, therefrom), a VHFWR3 amino acid sequence of SEQ ID NO: 6012 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6013.

In some embodiments, the antigen binding domain that targets NKp30 comprises a VL comprising a VLFWR1 amino acid sequence of SEQ ID NO: 6073 (or a sequence with no more than 1, 2, or 3 mutations, e.g., substitutions, additions, or deletions), a VLFWR2 amino acid sequence of SEQ ID NO: 6074 (or a sequence with no more than 1 mutation, e.g., substitution, addition, or deletion), a VLFWR3 amino acid sequence of SEQ ID NO: 6075 (or a sequence with no more than 1 mutation, e.g., substitution, addition, or deletion), and/or a VLFWR4 amino acid sequence of SEQ ID NO: 6076.

In some embodiments, the antigen binding domain that targets NKp30 comprises a VH comprising a VHFWR1 amino acid sequence of SEQ ID NO: 6010 (or a sequence with no more than 1, 2, 3, 4, 5, or 6 mutations, e.g., substitutions, additions, or deletions, therefrom), a VHFWR2 amino acid sequence of SEQ ID NO: 6011 (or a sequence with no more than 1, 2, 3, 4, 5, or 6 mutations, e.g., substitutions, additions, or deletions, therefrom), a VHFWR3 amino acid sequence of SEQ ID NO: 6012 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6013, and a VL comprising a VLFWR1 amino acid sequence of SEQ ID NO: 6073 (or a sequence with no more than 1, 2, or 3 mutations, e.g., substitutions, additions, or deletions), a VLFWR2 amino acid sequence of SEQ ID NO: 6074 (or a sequence with no more than 1 mutation, e.g., substitution, addition, or deletion), a VLFWR3 amino acid sequence of SEQ ID NO: 6075 (or a sequence with no more than 1 mutation, e.g., substitution, addition, or deletion), and/or a VLFWR4 amino acid sequence of SEQ ID NO: 6076.

In some embodiments, the antigen binding domain that targets NKp30 comprises a VH comprising a heavy chain framework region 1 (VHFWR1) amino acid sequence of SEQ ID NO: 6014, a VHFWR2 amino acid sequence of SEQ ID NO: 6015, a VHFWR3 amino acid sequence of SEQ ID NO: 6016, and/or a VHFWR4 amino acid sequence of SEQ ID NO: 6017.

In some embodiments, the antigen binding domain that targets NKp30 comprises a VH comprising a VHFWR1 amino acid sequence of SEQ ID NO: 6014 (or a sequence with no more than 1, 2, 3, 4, 5, or 6 mutations, e.g., substitutions, additions, or deletions, therefrom), a VHFWR2 amino acid sequence of SEQ ID NO: 6015 (or a sequence with no more than 1, 2, 3, 4, 5, or 6 mutations, e.g., substitutions, additions, or deletions, therefrom), a VHFWR3 amino acid sequence of SEQ ID NO: 6016 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6017.

In some embodiments, the antigen binding domain that targets NKp30 comprises a VL comprising a light chain framework region 1 (VLFWR1) amino acid sequence of SEQ ID NO: 6077, a VLFWR2 amino acid sequence of SEQ ID NO: 6078, a VLFWR3 amino acid sequence of SEQ ID NO: 6079, and/or a VLFWR4 amino acid sequence of SEQ ID NO: 6080.

In some embodiments, the antigen binding domain that targets NKp30 comprises a VL comprising a VLFWR1 amino acid sequence of SEQ ID NO: 6077 (or a sequence with no more than 1, 2, or 3 mutations, e.g., substitutions, additions, or deletions), a VLFWR2 amino acid sequence of SEQ ID NO: 6078 (or a sequence with no more than 1 mutation, e.g., substitution, addition, or deletion), a VLFWR3 amino acid sequence of SEQ ID NO: 6079 (or a sequence with no more than 1 mutation, e.g., substitution, addition, or deletion), and/or a VLFWR4 amino acid sequence of SEQ ID NO: 6080.

In some embodiments, the antigen binding domain that targets NKp30 comprises a VH comprising a heavy chain framework region 1 (VHFWR1) amino acid sequence of SEQ ID NO: 6018, a VHFWR2 amino acid sequence of SEQ ID NO: 6019, a VHFWR3 amino acid sequence of SEQ ID NO: 6020, and/or a VHFWR4 amino acid sequence of SEQ ID NO: 6021.

In some embodiments, the antigen binding domain that targets NKp30 comprises a VH comprising a VHFWR1 amino acid sequence of SEQ ID NO: 6018 (or a sequence with no more than 1, 2, 3, 4, 5, or 6 mutations, e.g., substitutions, additions, or deletions, therefrom), a VHFWR2 amino acid sequence of SEQ ID NO: 6019 (or a sequence with no more than 1, 2, 3, 4, 5, or 6 mutations, e.g., substitutions, additions, or deletions, therefrom), a VHFWR3 amino acid sequence of SEQ ID NO: 6020 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6021.

In some embodiments, the antigen binding domain that targets NKp30 comprises a VL comprising a light chain framework region 1 (VLFWR1) amino acid sequence of SEQ ID NO: 6081, a VLFWR2 amino acid sequence of SEQ ID NO: 6082, a VLFWR3 amino acid sequence of SEQ ID NO: 6083, and/or a VLFWR4 amino acid sequence of SEQ ID NO: 6084.

In some embodiments, the antigen binding domain that targets NKp30 comprises a VL comprising a VLFWR1 amino acid sequence of SEQ ID NO: 6081 (or a sequence with no more than 1, 2, or 3 mutations, e.g., substitutions, additions, or deletions), a VLFWR2 amino acid sequence of SEQ ID NO: 6082 (or a sequence with no more than 1 mutation, e.g., substitution, addition, or deletion), a VLFWR3 amino acid sequence of SEQ ID NO: 6083 (or a sequence with no more than 1 mutation, e.g., substitution, addition, or deletion), and/or a VLFWR4 amino acid sequence of SEQ ID NO: 6084.

In some embodiments, the antigen binding domain that targets NKp30 comprises a VH comprising a heavy chain framework region 1 (VHFWR1) amino acid sequence of SEQ ID NO: 6022, a VHFWR2 amino acid sequence of SEQ ID NO: 6023, a VHFWR3 amino acid sequence of SEQ ID NO: 6024, and/or a VHFWR4 amino acid sequence of SEQ ID NO: 6025.

In some embodiments, the antigen binding domain that targets NKp30 comprises a VH comprising a VHFWR1 amino acid sequence of SEQ ID NO: 6022 (or a sequence with no more than 1, 2, 3, 4, 5, or 6 mutations, e.g., substitutions, additions, or deletions, therefrom), a VHFWR2 amino acid sequence of SEQ ID NO: 6023 (or a sequence with no more than 1, 2, 3, 4, 5, or 6 mutations, e.g., substitutions, additions, or deletions, therefrom), a VHFWR3 amino acid sequence of SEQ ID NO: 6024 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6025.

In some embodiments, the antigen binding domain that targets NKp30 comprises a VL comprising a light chain framework region 1 (VLFWR1) amino acid sequence of SEQ ID NO: 6085, a VLFWR2 amino acid sequence of SEQ ID NO: 6086, a VLFWR3 amino acid sequence of SEQ ID NO: 6087, and/or a VLFWR4 amino acid sequence of SEQ ID NO: 6088.

In some embodiments, the antigen binding domain that targets NKp30 comprises a VL comprising a VLFWR1 amino acid sequence of SEQ ID NO: 6085 (or a sequence with no more than 1, 2, or 3 mutations, e.g., substitutions, additions, or deletions), a VLFWR2 amino acid sequence of SEQ ID NO: 6086 (or a sequence with no more than 1 mutation, e.g., substitution, addition, or deletion), a VLFWR3 amino acid sequence of SEQ ID NO: 6087 (or a sequence with no more than 1 mutation, e.g., substitution, addition, or deletion), and/or a VLFWR4 amino acid sequence of SEQ ID NO: 6088.

In some embodiments, the antigen binding domain that targets NKp30 comprises a VH comprising a heavy chain framework region 1 (VHFWR1) amino acid sequence of SEQ ID NO: 6026, a VHFWR2 amino acid sequence of SEQ ID NO: 6027, a VHFWR3 amino acid sequence of SEQ ID NO: 6028, and/or a VHFWR4 amino acid sequence of SEQ ID NO: 6029.

In some embodiments, the antigen binding domain that targets NKp30 comprises a VH comprising a VHFWR1 amino acid sequence of SEQ ID NO: 6026 (or a sequence with no more than 1, 2, 3, 4, 5, or 6 mutations, e.g., substitutions, additions, or deletions, therefrom), a VHFWR2 amino acid sequence of SEQ ID NO: 6027 (or a sequence with no more than 1, 2, 3, 4, 5, or 6 mutations, e.g., substitutions, additions, or deletions, therefrom), a VHFWR3 amino acid sequence of SEQ ID NO: 6028 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6029.

In some embodiments, the antigen binding domain that targets NKp30 comprises a VL comprising a light chain framework region 1 (VLFWR1) amino acid sequence of SEQ ID NO: 6089, a VLFWR2 amino acid sequence of SEQ ID NO: 6090, a VLFWR3 amino acid sequence of SEQ ID NO: 6091, and/or a VLFWR4 amino acid sequence of SEQ ID NO: 6092.

In some embodiments, the antigen binding domain that targets NKp30 comprises a VL comprising a VLFWR1 amino acid sequence of SEQ ID NO: 6089 (or a sequence with no more than 1, 2, or 3 mutations, e.g., substitutions, additions, or deletions), a VLFWR2 amino acid sequence of SEQ ID NO: 6090 (or a sequence with no more than 1 mutation, e.g., substitution, addition, or deletion), a VLFWR3 amino acid sequence of SEQ ID NO: 6091 (or a sequence with no more than 1 mutation, e.g., substitution, addition, or deletion), and/or a VLFWR4 amino acid sequence of SEQ ID NO: 6092.

In some embodiments, the antigen binding domain that targets NKp30 comprises a VH comprising a heavy chain framework region 1 (VHFWR1) amino acid sequence of SEQ ID NO: 6030, a VHFWR2 amino acid sequence of SEQ ID NO: 6032, a VHFWR3 amino acid sequence of SEQ ID NO: 6033, and/or a VHFWR4 amino acid sequence of SEQ ID NO: 6034.

In some embodiments, the antigen binding domain that targets NKp30 comprises a VH comprising a VHFWR1 amino acid sequence of SEQ ID NO: 6030 (or a sequence with no more than 1, 2, 3, 4, 5, or 6 mutations, e.g., substitutions, additions, or deletions, therefrom), a VHFWR2 amino acid sequence of SEQ ID NO: 6032 (or a sequence with no more than 1, 2, 3, 4, 5, or 6 mutations, e.g., substitutions, additions, or deletions, therefrom), a VHFWR3 amino acid sequence of SEQ ID NO: 6033 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6034.

In some embodiments, the antigen binding domain that targets NKp30 comprises a VL comprising a light chain framework region 1 (VLFWR1) amino acid sequence of SEQ ID NO: 6093, a VLFWR2 amino acid sequence of SEQ ID NO: 6094, a VLFWR3 amino acid sequence of SEQ ID NO: 6095, and/or a VLFWR4 amino acid sequence of SEQ ID NO: 6096.

In some embodiments, the antigen binding domain that targets NKp30 comprises a VL comprising a VLFWR1 amino acid sequence of SEQ ID NO: 6093 (or a sequence with no more than 1, 2, or 3 mutations, e.g., substitutions, additions, or deletions), a VLFWR2 amino acid sequence of SEQ ID NO: 6094 (or a sequence with no more than 1 mutation, e.g., substitution, addition, or deletion), a VLFWR3 amino acid sequence of SEQ ID NO: 6095 (or a sequence with no more than 1 mutation, e.g., substitution, addition, or deletion), and/or a VLFWR4 amino acid sequence of SEQ ID NO: 6096.

In some embodiments, the antigen binding domain that targets NKp30 comprises a VH comprising a heavy chain framework region 1 (VHFWR1) amino acid sequence of SEQ ID NO: 6035, a VHFWR2 amino acid sequence of SEQ ID NO: 6036, a VHFWR3 amino acid sequence of SEQ ID NO: 6037, and/or a VHFWR4 amino acid sequence of SEQ ID NO: 6038.

In some embodiments, the antigen binding domain that targets NKp30 comprises a VH comprising a VHFWR1 amino acid sequence of SEQ ID NO: 6035 (or a sequence with no more than 1, 2, 3, 4, 5, or 6 mutations, e.g., substitutions, additions, or deletions, therefrom), a VHFWR2 amino acid sequence of SEQ ID NO: 6036 (or a sequence with no more than 1, 2, 3, 4, 5, or 6 mutations, e.g., substitutions, additions, or deletions, therefrom), a VHFWR3 amino acid sequence of SEQ ID NO: 6037 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6038.

In some embodiments, the antigen binding domain that targets NKp30 comprises a VH comprising a heavy chain framework region 1 (VHFWR1) amino acid sequence of SEQ ID NO: 6039, a VHFWR2 amino acid sequence of SEQ ID NO: 6040, a VHFWR3 amino acid sequence of SEQ ID NO: 6041, and/or a VHFWR4 amino acid sequence of SEQ ID NO: 6042.

In some embodiments, the antigen binding domain that targets NKp30 comprises a VH comprising a VHFWR1 amino acid sequence of SEQ ID NO: 6039 (or a sequence with no more than 1, 2, 3, 4, 5, or 6 mutations, e.g., substitutions, additions, or deletions, therefrom), a VHFWR2 amino acid sequence of SEQ ID NO: 6040 (or a sequence with no more than 1, 2, 3, 4, 5, or 6 mutations, e.g., substitutions, additions, or deletions, therefrom), a VHFWR3 amino acid sequence of SEQ ID NO: 6041 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6042.

In some embodiments, the antigen binding domain that targets NKp30 comprises a VL comprising a light chain framework region 1 (VLFWR1) amino acid sequence of SEQ ID NO: 6097, a VLFWR2 amino acid sequence of SEQ ID NO: 6098, a VLFWR3 amino acid sequence of SEQ ID NO: 6099, and/or a VLFWR4 amino acid sequence of SEQ ID NO: 6100.

In some embodiments, the antigen binding domain that targets NKp30 comprises a VL comprising a VLFWR1 amino acid sequence of SEQ ID NO: 6097 (or a sequence with no more than 1, 2, or 3 mutations, e.g., substitutions, additions, or deletions), a VLFWR2 amino acid sequence of SEQ ID NO: 6098 (or a sequence with no more than 1 mutation, e.g., substitution, addition, or deletion), a VLFWR3 amino acid sequence of SEQ ID NO: 6099 (or a sequence with no more than 1 mutation, e.g., substitution, addition, or deletion), and/or a VLFWR4 amino acid sequence of SEQ ID NO: 6100.

In some embodiments, the antigen binding domain that targets NKp30 comprises a VH comprising a heavy chain framework region 1 (VHFWR1) amino acid sequence of SEQ ID NO: 6043, a VHFWR2 amino acid sequence of SEQ ID NO: 6044, a VHFWR3 amino acid sequence of SEQ ID NO: 6045, and/or a VHFWR4 amino acid sequence of SEQ ID NO: 6046.

In some embodiments, the antigen binding domain that targets NKp30 comprises a VH comprising a VHFWR1 amino acid sequence of SEQ ID NO: 6043 (or a sequence with no more than 1, 2, 3, 4, 5, or 6 mutations, e.g., substitutions, additions, or deletions, therefrom), a VHFWR2 amino acid sequence of SEQ ID NO: 6044 (or a sequence with no more than 1, 2, 3, 4, 5, or 6 mutations, e.g., substitutions, additions, or deletions, therefrom), a VHFWR3 amino acid sequence of SEQ ID NO: 6045 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6046.

In some embodiments, the antigen binding domain that targets NKp30 comprises a VL comprising a light chain framework region 1 (VLFWR1) amino acid sequence of SEQ ID NO: 6101, a VLFWR2 amino acid sequence of SEQ ID NO: 6102, a VLFWR3 amino acid sequence of SEQ ID NO: 6103, and/or a VLFWR4 amino acid sequence of SEQ ID NO: 6104.

In some embodiments, the antigen binding domain that targets NKp30 comprises a VL comprising a VLFWR1 amino acid sequence of SEQ ID NO: 6101 (or a sequence with no more than 1, 2, or 3 mutations, e.g., substitutions, additions, or deletions), a VLFWR2 amino acid sequence of SEQ ID NO: 6102 (or a sequence with no more than 1 mutation, e.g., substitution, addition, or deletion), a VLFWR3 amino acid sequence of SEQ ID NO: 6103 (or a sequence with no more than 1 mutation, e.g., substitution, addition, or deletion), and/or a VLFWR4 amino acid sequence of SEQ ID NO: 6104.

In some embodiments, the antigen binding domain that targets NKp30 comprises a VH comprising a heavy chain framework region 1 (VHFWR1) amino acid sequence of SEQ ID NO: 6047, a VHFWR2 amino acid sequence of SEQ ID NO: 6048, a VHFWR3 amino acid sequence of SEQ ID NO: 6049, and/or a VHFWR4 amino acid sequence of SEQ ID NO: 6050.

In some embodiments, the antigen binding domain that targets NKp30 comprises a VH comprising a VHFWR1 amino acid sequence of SEQ ID NO: 6047 (or a sequence with no more than 1, 2, 3, 4, 5, or 6 mutations, e.g., substitutions, additions, or deletions, therefrom), a VHFWR2 amino acid sequence of SEQ ID NO: 6048 (or a sequence with no more than 1, 2, 3, 4, 5, or 6 mutations, e.g., substitutions, additions, or deletions, therefrom), a VHFWR3 amino acid sequence of SEQ ID NO: 6049 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6050.

In some embodiments, the antigen binding domain that targets NKp30 comprises a VL comprising a light chain framework region 1 (VLFWR1) amino acid sequence of SEQ ID NO: 6105, a VLFWR2 amino acid sequence of SEQ ID NO: 6106, a VLFWR3 amino acid sequence of SEQ ID NO: 6107, and/or a VLFWR4 amino acid sequence of SEQ ID NO: 6108.

In some embodiments, the antigen binding domain that targets NKp30 comprises a VL comprising a VLFWR1 amino acid sequence of SEQ ID NO: 6105 (or a sequence with no more than 1, 2, or 3 mutations, e.g., substitutions, additions, or deletions), a VLFWR2 amino acid sequence of SEQ ID NO: 6106 (or a sequence with no more than 1 mutation, e.g., substitution, addition, or deletion), a VLFWR3 amino acid sequence of SEQ ID NO: 6107 (or a sequence with no more than 1 mutation, e.g., substitution, addition, or deletion), and/or a VLFWR4 amino acid sequence of SEQ ID NO: 6108.

In some embodiments, the antigen binding domain that targets NKp30 comprises a VH comprising a heavy chain framework region 1 (VHFWR1) amino acid sequence of SEQ ID NO: 6051, a VHFWR2 amino acid sequence of SEQ ID NO: 6052, a VHFWR3 amino acid sequence of SEQ ID NO: 6053, and/or a VHFWR4 amino acid sequence of SEQ ID NO: 6054.

In some embodiments, the antigen binding domain that targets NKp30 comprises a VH comprising a VHFWR1 amino acid sequence of SEQ ID NO: 6051 (or a sequence with no more than 1, 2, 3, 4, 5, or 6 mutations, e.g., substitutions, additions, or deletions, therefrom), a VHFWR2 amino acid sequence of SEQ ID NO: 6052 (or a sequence with no more than 1, 2, 3, 4, 5, or 6 mutations, e.g., substitutions, additions, or deletions, therefrom), a VHFWR3 amino acid sequence of SEQ ID NO: 6053 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6054.

In some embodiments, the antigen binding domain that targets NKp30 comprises a VL comprising a light chain framework region 1 (VLFWR1) amino acid sequence of SEQ ID NO: 6109, a VLFWR2 amino acid sequence of SEQ ID NO: 6110, a VLFWR3 amino acid sequence of SEQ ID NO: 6111, and/or a VLFWR4 amino acid sequence of SEQ ID NO: 6112.

In some embodiments, the antigen binding domain that targets NKp30 comprises a VL comprising a VLFWR1 amino acid sequence of SEQ ID NO: 6109 (or a sequence with no more than 1, 2, or 3 mutations, e.g., substitutions, additions, or deletions), a VLFWR2 amino acid sequence of SEQ ID NO: 6110 (or a sequence with no more than 1 mutation, e.g., substitution, addition, or deletion), a VLFWR3 amino acid sequence of SEQ ID NO: 6111 (or a sequence with no more than 1 mutation, e.g., substitution, addition, or deletion), and/or a VLFWR4 amino acid sequence of SEQ ID NO: 6112.

In some embodiments, the antigen binding domain that targets NKp30 comprises a VH comprising a heavy chain framework region 1 (VHFWR1) amino acid sequence of SEQ ID NO: 6055, a VHFWR2 amino acid sequence of SEQ ID NO: 6056, a VHFWR3 amino acid sequence of SEQ ID NO: 6057, and/or a VHFWR4 amino acid sequence of SEQ ID NO: 6058.

In some embodiments, the antigen binding domain that targets NKp30 comprises a VH comprising a VHFWR1 amino acid sequence of SEQ ID NO: 6055 (or a sequence with no more than 1, 2, 3, 4, 5, or 6 mutations, e.g., substitutions, additions, or deletions, therefrom), a VHFWR2 amino acid sequence of SEQ ID NO: 6056 (or a sequence with no more than 1, 2, 3, 4, 5, or 6 mutations, e.g., substitutions, additions, or deletions, therefrom), a VHFWR3 amino acid sequence of SEQ ID NO: 6057 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6058.

In some embodiments, the antigen binding domain that targets NKp30 comprises a VL comprising a light chain framework region 1 (VLFWR1) amino acid sequence of SEQ ID NO: 6113, a VLFWR2 amino acid sequence of SEQ ID NO: 6114, a VLFWR3 amino acid sequence of SEQ ID NO: 6115, and/or a VLFWR4 amino acid sequence of SEQ ID NO: 6116.

In some embodiments, the antigen binding domain that targets NKp30 comprises a VL comprising a VLFWR1 amino acid sequence of SEQ ID NO: 6113 (or a sequence with no more than 1, 2, or 3 mutations, e.g., substitutions, additions, or deletions), a VLFWR2 amino acid sequence of SEQ ID NO: 6114 (or a sequence with no more than 1 mutation, e.g., substitution, addition, or deletion), a VLFWR3 amino acid sequence of SEQ ID NO: 6115 (or a sequence with no more than 1 mutation, e.g., substitution, addition, or deletion), and/or a VLFWR4 amino acid sequence of SEQ ID NO: 6116.

In some embodiments, the antigen binding domain that targets NKp30 comprises a VH comprising a heavy chain framework region 1 (VHFWR1) amino acid sequence of SEQ ID NO: 6059, a VHFWR2 amino acid sequence of SEQ ID NO: 6060, a VHFWR3 amino acid sequence of SEQ ID NO: 6061, and/or a VHFWR4 amino acid sequence of SEQ ID NO: 6062.

In some embodiments, the antigen binding domain that targets NKp30 comprises a VH comprising a VHFWR1 amino acid sequence of SEQ ID NO: 6059 (or a sequence with no more than 1, 2, 3, 4, 5, or 6 mutations, e.g., substitutions, additions, or deletions, therefrom), a VHFWR2 amino acid sequence of SEQ ID NO: 6060 (or a sequence with no more than 1, 2, 3, 4, 5, or 6 mutations, e.g., substitutions, additions, or deletions, therefrom), a VHFWR3 amino acid sequence of SEQ ID NO: 6061 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6062.

In some embodiments, the antigen binding domain that targets NKp30 comprises a VL comprising a light chain framework region 1 (VLFWR1) amino acid sequence of SEQ ID NO: 6117, a VLFWR2 amino acid sequence of SEQ ID NO: 6118, a VLFWR3 amino acid sequence of SEQ ID NO: 6119, and/or a VLFWR4 amino acid sequence of SEQ ID NO: 6120.

In some embodiments, the antigen binding domain that targets NKp30 comprises a VL comprising a VLFWR1 amino acid sequence of SEQ ID NO: 6117 (or a sequence with no more than 1, 2, or 3 mutations, e.g., substitutions, additions, or deletions), a VLFWR2 amino acid sequence of SEQ ID NO: 6118 (or a sequence with no more than 1 mutation, e.g., substitution, addition, or deletion), a VLFWR3 amino acid sequence of SEQ ID NO: 6119 (or a sequence with no more than 1 mutation, e.g., substitution, addition, or deletion), and/or a VLFWR4 amino acid sequence of SEQ ID NO: 6120.

In some embodiments, the antigen binding domain that targets NKp30 comprises a VH comprising the amino acid sequence of SEQ ID NO: 6148 (or an amino acid sequence having at least about 77%, 80%, 85%, 90%, 95%, or 99% sequence identity to SEQ ID NO: 6148). In some embodiments, the antigen binding domain that targets NKp30 comprises a VH comprising the amino acid sequence of SEQ ID NO: 6149 (or an amino acid sequence having at least about 77%, 80%, 85%, 90%, 95%, or 99% sequence identity to SEQ ID NO: 6149). In some embodiments, the antigen binding domain that targets NKp30 comprises a VL comprising the amino acid sequence of SEQ ID NO: 6150 (or an amino acid sequence having at least about 93%, 95%, or 99% sequence identity to SEQ ID NO: 6150). In some embodiments, antigen binding domain that targets NKp30 comprises a VH comprising the amino acid sequence of SEQ ID NO: 6148. In some embodiments, antigen binding domain that targets NKp30 comprises a VH comprising the amino acid sequence of SEQ ID NO: 6149. In some embodiments, the antigen binding domain that targets NKp30 comprises a VL comprising the amino acid sequence of SEQ ID NO: 6150.

In some embodiments, the antigen binding domain that targets NKp30 comprises a VH comprising the amino acid sequence of SEQ ID NO: 6148, and a VL comprising the amino acid sequence of SEQ ID NO: 6150. In some embodiments, the antigen binding domain that targets NKp30 comprises a VH comprising the amino acid sequence of SEQ ID NO: 6149, and a VL comprising the amino acid sequence of SEQ ID NO: 6150.

In some embodiments, the antigen binding domain that targets NKp30 comprises a VH comprising the amino acid sequence of SEQ ID NO: 6151 (or an amino acid sequence having at least about 77%, 80%, 85%, 90%, 95%, or 99% sequence identity to SEQ ID NO: 6151). In some embodiments, the antigen binding domain that targets NKp30 comprises a VH comprising the amino acid sequence of SEQ ID NO: 6152 (or an amino acid sequence having at least about 77%, 80%, 85%, 90%, 95%, or 99% sequence identity to SEQ ID NO: 6152). In some embodiments, the antigen binding domain that targets NKp30 comprises a VL comprising the amino acid sequence of SEQ ID NO: 6153 (or an amino acid sequence having at least about 93%, 95%, or 99% sequence identity to SEQ ID NO: 6153). In some embodiments, antigen binding domain that targets NKp30 comprises a VH comprising the amino acid sequence of SEQ ID NO: 6151. In some embodiments, antigen binding domain that targets NKp30 comprises a VH comprising the amino acid sequence of SEQ ID NO: 6152. In some embodiments, the antigen binding domain that targets NKp30 comprises a VL comprising the amino acid sequence of SEQ ID NO: 6153.

In some embodiments, the antigen binding domain that targets NKp30 comprises a VH comprising the amino acid sequence of SEQ ID NO: 6151, and a VL comprising the amino acid sequence of SEQ ID NO: 6153. In some embodiments, the antigen binding domain that targets NKp30 comprises a VH comprising the amino acid sequence of SEQ ID NO: 6152, and a VL comprising the amino acid sequence of SEQ ID NO: 6153.

In some embodiments, the antigen binding domain that targets NKp30 comprises an scFv. In some embodiments, the scFv comprises an amino acid sequence selected from SEQ ID NOs: 6187-6190, or an amino acid sequence having at least about 93%, 95%, or 99% sequence identity thereto.

TABLE 20A

Exemplary heavy chain CDRs and FWRs of NKp30-targeting antigen binding domains (According to Kabat numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| 9G1-HC | QIQLQESGPGLVKPSQSLSLTCSVTGFSINTG (SEQ ID NO: 6003) | GYHWN (SEQ ID NO: 6000) | WIRQFPGKKLEWMG (SEQ ID NO: 6004) | YIYSSGSTSYNPSLKS (SEQ ID NO: 6001) | RISITRDTSKNQFFLQLNSVTTEDTATYYCAR (SEQ ID NO: 6005) | GNWHYFDF (SEQ ID NO: 6002) | WGQGTMVTVSS (SEQ ID NO: 6006) |
| 15H6-HC | QIQLQESGPGLVKPSQSLSLTCSVTGFSINTG (SEQ ID NO: 6010) | GYHWN (SEQ ID NO: 6007) | WIRQFPGKKLEWMG (SEQ ID NO: 6011) | YIYSSGTTRYNPSLKS (SEQ ID NO: 6008) | RISITRDTSKNQFFLQLNSVTPEDTATYYCTR (SEQ ID NO: 6012) | GNWHYFDY (SEQ ID NO: 6009) | WGQGTLVAVSS (SEQ ID NO: 6013) |
| 9G1-HC_1 | QIQLQESGPGLVKPSETLSLTCTVSGFSINTG (SEQ ID NO: 6014) | GYHWN (SEQ ID NO: 6000) | WIRQPAGKGLEWIG (SEQ ID NO: 6015) | YIYSSGSTSYNPSLKS (SEQ ID NO: 6001) | RVTMSRDTSKNQFSLKLSSVTAADTAVYYCAR (SEQ ID NO: 6016) | GNWHYFDF (SEQ ID NO: 6002) | WGQGTMVTVSS (SEQ ID NO: 6017) |
| 9G1-HC_2 | QIQLQESGPGLVKPSQTLSLTCTVSGFSINTG (SEQ ID NO: 6018) | GYHWN (SEQ ID NO: 6000) | WIRQHPGKGLEWIG (SEQ ID NO: 6019) | YIYSSGSTSYNPSLKS (SEQ ID NO: 6001) | LVTISRDTSKNQFSLKLSSVTAADTAVYYCAR (SEQ ID NO: 6020) | GNWHYFDF (SEQ ID NO: 6002) | WGQGTMVTVSS (SEQ ID NO: 6021) |
| 9G1-HC_3 | EIQLLESGGGLVQPGGSLRLSCAVSGFSINTG (SEQ ID NO: 6022) | GYHWN (SEQ ID NO: 6000) | WVRQAPGKGLEWVG (SEQ ID NO: 6023) | YIYSSGSTSYNPSLKS (SEQ ID NO: 6001) | RFTISRDTSKNTFYLQMNSLRAEDTAVYYCAR (SEQ ID NO: 6024) | GNWHYFDF (SEQ ID NO: 6002) | WGQGTMVTVSS (SEQ ID NO: 6025) |
| 9G1-HC_4 | QIQLVQSGAEVKKPGSSVKVSCKVSGFSINTG (SEQ ID NO: 6026) | GYHWN (SEQ ID NO: 6000) | WVRQAPGQGLEWMG (SEQ ID NO: 6027) | YIYSSGSTSYNPSLKS (SEQ ID NO: 6001) | RVTITRDTSTNTFYMELSSLRSEDTAVYYCAR (SEQ ID NO: 6028) | GNWHYFDF (SEQ ID NO: 6002) | WGQGTMVTVSS (SEQ ID NO: 6029) |
| 9G1-HC_5 | EIQLVESGGGLVQPGGSLRLSCAVSGFSINTG (SEQ ID NO: 6030) | GYHWN (SEQ ID NO: 6000) | WVRQAPGKGLEWVG (SEQ ID NO: 6032) | YIYSSGSTSYNPSLKS (SEQ ID NO: 6001) | RFTISRDTAKNSFYLQMNSLRAEDTAVYYCAR (SEQ ID NO: 6033) | GNWHYFDF (SEQ ID NO: 6002) | WGQGTMVTVSS (SEQ ID NO: 6034) |
| 9G1-HC_6 | QIQLVQSGAEVKKPGASVKVSCKVSGFSINTG (SEQ ID NO: 6035) | GYHWN (SEQ ID NO: 6000) | WVRQAPGQGLEWMG (SEQ ID NO: 6036) | YIYSSGSTSYNPSLKS (SEQ ID NO: 6001) | RVTMTRDTSTNTFYMELSSLRSEDTAVYYCAR (SEQ ID NO: 6037) | GNWHYFDF (SEQ ID NO: 6002) | WGQGTMVTVSS (SEQ ID NO: 6038) |
| 15H6-HC_1 | QIQLQESGPGLVKPSQTLSLTCTVSGFSINTG (SEQ ID NO: 6039) | GYHWN (SEQ ID NO: 6007) | WIR QHPGKGLEWIG (SEQ ID NO: 6040) | YIYSSGTTRYNPSLKS (SEQ ID NO: 6008) | LVTISRDTSKNQFSLKLSSVTAADTAVYYCAR (SEQ ID NO: 6041) | GNWHYFDY (SEQ ID NO: 6009) | WGQGTLVTVSS (SEQ ID NO: 6042) |

TABLE 20A-continued

Exemplary heavy chain CDRs and FWRs of NKp30-targeting antigen binding domains (According to Kabat numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| 15H6-HC_2 | QIQLQESG PGLVKPSE TLSLTCTV SGFSINTG (SEQ ID NO: 6043) | GYHWN (SEQ ID NO: 6007) | WIRQPA GKGLE WIG (SEQ ID NO: 6044) | YIYSSGT TRYNPS LKS (SEQ ID NO: 6008) | RVTMSRD TSKNQFSL KLSSVTA ADTAVYY CAR (SEQ ID NO: 6045) | GNWHY FDY (SEQ ID NO: 6009) | WGQGTL VTVSS (SEQ ID NO: 6046) |
| 15H6-HC_3 | EIQLLESG GGLVQPG GSLRLSCA VSGFSINT G (SEQ ID NO: 6047) | GYHWN (SEQ ID NO: 6007) | WVRQA PGKGLE WVG (SEQ ID NO: 6048) | YIYSSGT TRYNPS LKS (SEQ ID NO: 6008) | RFTISRDT SKNTFYL QMNSLRA EDTAVYY CAR (SEQ ID NO: 6049) | GNWHY FDY (SEQ ID NO: 6009) | WGQGTL VTVSS (SEQ ID NO: 6050) |
| 15H6-HC_4 | QIQLVESG GGLVKPG GSLRLSCA VSGFSINT G (SEQ ID NO: 6051) | GYHWN (SEQ ID NO: 6007) | WIRQAP GKGLE WVG (SEQ ID NO: 6052) | YIYSSGT TRYNPS LKS (SEQ ID NO: 6008) | RFTISRDT AKNSFYL QMNSLRA EDTAVYY CAR (SEQ ID NO: 6053) | GNWHY FDY (SEQ ID NO: 6009) | WGQGTL VTVSS (SEQ ID NO: 6054) |
| 15H6-HC_5 | QIQLVQSG AEVKKPG ASVKVSCK VSGFSINT G (SEQ ID NO: 6055) | GYHWN (SEQ ID NO: 6007) | WVRQA PGQGLE WMG (SEQ ID NO: 6056) | YIYSSGT TRYNPS LKS (SEQ ID NO: 6008) | RVTMTRD TSTNTFY MELSSLRS EDTAVYY CAR (SEQ ID NO: 6057) | GNWHY FDY (SEQ ID NO: 6009) | WGQGTL VTVSS (SEQ ID NO: 6058) |
| 15H6-HC_6 | EIQLVQSG AEVKKPG ATVKISCK VSGFSINT G (SEQ ID NO: 6059) | GYHWN (SEQ ID NO: 6007) | WVQQA PGKGLE WMG (SEQ ID NO: 6060) | YIYSSGT TRYNPS LKS (SEQ ID NO: 6008) | RVTITRDT STNTFYM ELSSLRSE DTAVYYC AR (SEQ ID NO: 6061) | GNWHY FDY (SEQ ID NO: 6009) | WGQGTL VTVSS (SEQ ID NO: 6062) |

TABLE 20B

Exemplary heavy chain CDRs and FWRs of NKp30-targeting antigen binding domains of Table 20A (According to ABM numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| 9G1-HC | QIQLQESG PGLVKPSQ SLSLTCSV T (SEQ ID NO: 8553) | GFSINTG GYHWN (SEQ ID NO: 8554) | WIRQFP GKKLE WMG (SEQ ID NO: 6004) | YIYSSGS TSYNPSL KS (SEQ ID NO: 6001) | RISITRDTS KNQFFLQ LNSVTTE DTATYYC AR (SEQ ID NO: 6005) | GNWHY FDF (SEQ ID NO: 6002) | WGQGT MVTVSS (SEQ ID NO: 6006) |
| 15H6-HC | QIQLQESG PGLVKPSQ SLSLTCSV T (SEQ ID NO: 8555) | GFSINTG GYHWN (SEQ ID NO: 8556) | WIRQFP GKKLE WMG (SEQ ID NO: 6011) | YIYSSGT TRYNPS LKS (SEQ ID NO: 6008) | RISITRDTS KNQFFLQ LNSVTPED TATYYCT R (SEQ ID NO: 6012) | GNWHY FDY (SEQ ID NO: 6009) | WGQGTL VAVSS (SEQ ID NO: 6013) |
| 9G1-HC_1 | QIQLQESG PGLVKPSE TLSLTCTV S (SEQ ID NO: 8557) | GFSINTG GYHWN (SEQ ID NO: 8558) | WIRQPA GKGLE WIG (SEQ ID NO: 6015) | YIYSSGS TSYNPSL KS (SEQ ID NO: 6001) | RVTMSRD TSKNQFSL KLSSVTA ADTAVYY CAR (SEQ ID NO: 6016) | GNWHY FDF (SEQ ID NO: 6002) | WGQGT MVTVSS (SEQ ID NO: 6017) |

TABLE 20B-continued

Exemplary heavy chain CDRs and FWRs of NKp30-targeting antigen binding domains of Table 20A (According to ABM numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| 9G1-HC_2 | QIQLQESGPGLVKPSQTLSLTCTVS (SEQ ID NO: 8559) | GFSINTGGYHWN (SEQ ID NO: 8560) | WIRQHPGKGLEWIG (SEQ ID NO: 6019) | YIYSSGSTSYNPSLKS (SEQ ID NO: 6001) | LVTISRDTSKNQFSLKLSSVTAADTAVYYCAR (SEQ ID NO: 6020) | GNWHYFDF (SEQ ID NO: 6002) | WGQGTMVTVSS (SEQ ID NO: 6021) |
| 9G1-HC_3 | EIQLLESGGGLVQPGGSLRLSCAVS (SEQ ID NO: 8561) | GFSINTGGYHWN (SEQ ID NO: 8562) | WVRQAPGKGLEWVG (SEQ ID NO: 6023) | YIYSSGSTSYNPSLKS (SEQ ID NO: 6001) | RFTISRDTSKNTFYLQMNSLRAEDTAVYYCAR (SEQ ID NO: 6024) | GNWHYFDF (SEQ ID NO: 6002) | WGQGTMVTVSS (SEQ ID NO: 6025) |
| 9G1-HC_4 | QIQLVQSGAEVKKPGSSVKVSCKVS (SEQ ID NO: 8563) | GFSINTGGYHWN (SEQ ID NO: 8564) | WVRQAPGQGLEWMG (SEQ ID NO: 6027) | YIYSSGSTSYNPSLKS (SEQ ID NO: 6001) | RVTITRDTSTNTFYMELSSLRSEDTAVYYCAR (SEQ ID NO: 6028) | GNWHYFDF (SEQ ID NO: 6002) | WGQGTMVTVSS (SEQ ID NO: 6029) |
| 9G1-HC_5 | EIQLVESGGGLVQPGGSLRLSCAVS (SEQ ID NO: 8565) | GFSINTGGYHWN (SEQ ID NO: 8566) | WVRQAPGKGLEWVG (SEQ ID NO: 6032) | YIYSSGSTSYNPSLKS (SEQ ID NO: 6001) | RFTISRDTAKNSFYLQMNSLRAEDTAVYYCAR (SEQ ID NO: 6033) | GNWHYFDF (SEQ ID NO: 6002) | WGQGTMVTVSS (SEQ ID NO: 6034) |
| 9G1-HC_6 | QIQLVQSGAEVKKPGASVKVSCKVS (SEQ ID NO: 8567) | GFSINTGGYHWN (SEQ ID NO: 8568) | WVRQAPGQGLEWMG (SEQ ID NO: 6036) | YIYSSGSTSYNPSLKS (SEQ ID NO: 6001) | RVTMTRDTSTNTFYMELSSLRSEDTAVYYCAR (SEQ ID NO: 6037) | GNWHYFDF (SEQ ID NO: 6002) | WGQGTMVTVSS (SEQ ID NO: 6038) |
| 15H6-HC_1 | QIQLQESGPGLVKPSQTLSLTCTVS (SEQ ID NO: 8569) | GFSINTGGYHWN (SEQ ID NO: 8570) | WIRQHPGKGLEWIG (SEQ ID NO: 6040) | YIYSSGTTRYNPSLKS (SEQ ID NO: 6008) | LVTISRDTSKNQFSLKLSSVTAADTAVYYCAR (SEQ ID NO: 6041) | GNWHYFDY (SEQ ID NO: 6009) | WGQGTLVTVSS (SEQ ID NO: 6042) |
| 15H6-HC_2 | QIQLQESGPGLVKPSETLSLTCTVS (SEQ ID NO: 8571) | GFSINTGGYHWN (SEQ ID NO: 8572) | WIRQPAGKGLEWIG (SEQ ID NO: 6044) | YIYSSGTTRYNPSLKS (SEQ ID NO: 6008) | RVTMSRDTSKNQFSLKLSSVTAADTAVYYCAR (SEQ ID NO: 6045) | GNWHYFDY (SEQ ID NO: 6009) | WGQGTLVTVSS (SEQ ID NO: 6046) |
| 15H6-HC_3 | EIQLLESGGGLVQPGGSLRLSCAVS (SEQ ID NO: 8573) | GFSINTGGYHWN (SEQ ID NO: 8574) | WVRQAPGKGLEWVG (SEQ ID NO: 6048) | YIYSSGTTRYNPSLKS (SEQ ID NO: 6008) | RFTISRDTSKNTFYLQMNSLRAEDTAVYYCAR (SEQ ID NO: 6049) | GNWHYFDY (SEQ ID NO: 6009) | WGQGTLVTVSS (SEQ ID NO: 6050) |
| 15H6-HC_4 | QIQLVESGGGLVKPGGSLRLSCAVS (SEQ ID NO: 8575) | GFSINTGGYHWN (SEQ ID NO: 8576) | WIRQAPGKGLEWVG (SEQ ID NO: 6052) | YIYSSGTTRYNPSLKS (SEQ ID NO: 6008) | RFTISRDTAKNSFYLQMNSLRAEDTAVYYCAR (SEQ ID NO: 6053) | GNWHYFDY (SEQ ID NO: 6009) | WGQGTLVTVSS (SEQ ID NO: 6054) |
| 15H6-HC_5 | QIQLVQSGAEVKKPG | GFSINTGGYHWN | WVRQAPGQGLE | YIYSSGTTRYNPS | RVTMTRDTSTNTFY | GNWHYFDY | WGQGTLVTVSS |

TABLE 20B-continued

Exemplary heavy chain CDRs and FWRs of NKp30-targeting antigen binding domains of Table 20A (According to ABM numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| | ASVKVSCK VS (SEQ ID NO: 8577) | (SEQ ID NO: 8578) | WMG (SEQ ID NO: 6056) | LKS (SEQ ID NO: 6008) | MELSSLRS EDTAVYY CAR (SEQ ID NO: 6057) | (SEQ ID NO: 6009) | (SEQ ID NO: 6058) |
| 15H6-HC_6 | EIQLVQSG AEVKKPG ATVKISCK VS (SEQ ID NO: 8579) | GFSINTG GYHWN (SEQ ID NO: 8580) | WVQQA PGKGLE WMG (SEQ ID NO: 6060) | YIYSSGT TRYNPS LKS (SEQ ID NO: 6008) | RVTITRDT STNTFYM ELSSLRSE DTAVYYC AR (SEQ ID NO: 6061) | GNWHY FDY (SEQ ID NO: 6009) | WGQGTL VTVSS (SEQ ID NO: 6062) |

TABLE 21A

Exemplary heavy chain CDRs and FWRs of NKp30-targeting antigen binding dom: (according to the Kabat numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| 9G1-HC | QIQLQESG PGLVKPS QSLSLTCS VTGFSINT G (SEQ ID NO: 7317) | GYHW N (SEQ ID NO: 7313) | WIRQFP GKKLEW MG (SEQ ID NO: 6004) | YIYSSG STSYNP SLKS (SEQ ID NO: 6001) | RISITRDTS KNQFFLQ LNSVTTE DTATYYC AR (SEQ ID NO: 6005) | GNWHY FDF (SEQ ID NO: 6002) | WGQGT MVTVSS (SEQ ID NO: 6006) |
| 15H6-HC | QIQLQESG PGLVKPS QSLSLTCS VTGFSINT G (SEQ ID NO: 7317) | GYHW N (SEQ ID NO: 7313) | WIRQFP GKKLEW MG (SEQ ID NO: 6011) | YIYSSG TTRYNP SLKS (SEQ ID NO: 6008) | RISITRDTS KNQFFLQ LNSVTPED TATYYCT R (SEQ ID NO: 6012) | GNWHY FDY (SEQ ID NO: 6009) | WGQGTL VAVSS (SEQ ID NO: 6013) |
| 9G1-HC_1 | QIQLQESG PGLVKPSE TLSLTCTV SGFSINTG (SEQ ID NO: 7371) | GYHW N (SEQ ID NO: 7313) | WIRQPA GKGLEW IG (SEQ ID NO: 6015) | YIYSSG STSYNP SLKS (SEQ ID NO: 6001) | RVTMSRD TSKNQFSL KLSSVTA ADTAVYY CAR (SEQ ID NO: 6016) | GNWHY FDF (SEQ ID NO: 6002) | WGQGT MVTVSS (SEQ ID NO: 6017) |
| 9G1-HC_2 | QIQLQESG PGLVKPS QTLSLTCT VSGFSINT G (SEQ ID NO: 7372) | GYHW N (SEQ ID NO: 7313) | WIRQHP GKGLEW IG (SEQ ID NO: 6019) | YIYSSG STSYNP SLKS (SEQ ID NO: 6001) | LVTISRDT SKNQFSL KLSSVTA ADTAVYY CAR (SEQ ID NO: 6020) | GNWHY FDF (SEQ ID NO: 6002) | WGQGT MVTVSS (SEQ ID NO: 6021) |
| 9G1-HC_3 | EIQLLESG GGLVQPG GSLRLSCA VSGFSINT G (SEQ ID NO: 7373) | GYHW N (SEQ ID NO: 7313) | WVRQAP GKGLEW VG (SEQ ID NO: 6023) | YIYSSG STSYNP SLKS (SEQ ID NO: 6001) | RFTISRDT SKNTFYL QMNSLRA EDTAVYY CAR (SEQ ID NO: 6024) | GNWHY FDF (SEQ ID NO: 6002) | WGQGT MVTVSS (SEQ ID NO: 6025) |
| 9G1-HC_4 | QIQLVQSG AEVKKPG SSVKVSC KVSGFSIN TG (SEQ ID NO: 7374) | GYHW N (SEQ ID NO: 7313) | WVRQAP GQGLEW MG (SEQ ID NO: 6027) | YIYSSG STSYNP SLKS (SEQ ID NO: 6001) | RVTITRDT STNTFYM ELSSLRSE DTAVYYC AR (SEQ ID NO: 6028) | GNWHY FDF (SEQ ID NO: 6002) | WGQGT MVTVSS (SEQ ID NO: 6029) |
| 9G1-HC_5 | EIQLVESG GGLVQPG GSLRLSCA VSGFSINT | GYHW N (SEQ ID NO: 7313) | WVRQAP GKGLEW VG (SEQ ID NO: | YIYSSG STSYNP SLKS (SEQ ID | RFTISRDT AKNSFYL QMNSLRA EDTAVYY | GNWHY FDF (SEQ ID NO: | WGQGT MVTVSS (SEQ ID NO: |

TABLE 21A-continued

Exemplary heavy chain CDRs and FWRs of NKp30-targeting antigen binding dom: (according to the Kabat numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| | G (SEQ ID NO: 7375) | | 6032) | NO: 6001) | CAR (SEQ ID NO: 6033) | 6002) | 6034) |
| 9G1-HC_6 | QIQLVQSGAEVKKPGASVKVSCKVSGFSINTG (SEQ ID NO: 7376) | GYHWN (SEQ ID NO: 7313) | WVRQAPGQGLEWMG (SEQ ID NO: 6036) | YIYSSGSTSYNPSLKS (SEQ ID NO: 6001) | RVTMTRDTSTNTFYMELSSLRSEDTAVYYCAR (SEQ ID NO: 6037) | GNWHYFDF (SEQ ID NO: 6002) | WGQGTMVTVSS (SEQ ID NO: 6038) |
| 15H6-HC_1 | QIQLQESGPGLVKPSQTLSLTCTVSGFSINTG (SEQ ID NO: 7372) | GYHWN (SEQ ID NO: 7313) | WIRQHPGKGLEWIG (SEQ ID NO: 6040) | YIYSSGTTRYNPSLKS (SEQ ID NO: 6008) | LVTISRDTSKNQFSLKLSSVTAADTAVYYCAR (SEQ ID NO: 6041) | GNWHYFDY (SEQ ID NO: 6009) | WGQGTLVTVSS (SEQ ID NO: 6042) |
| 15H6-HC_2 | QIQLQESGPGLVKPSETLSLTCTVSGFSINTG (SEQ ID NO: 7371) | GYHWN (SEQ ID NO: 7313) | WIRQPAGKGLEWIG (SEQ ID NO: 6044) | YIYSSGTTRYNPSLKS (SEQ ID NO: 6008) | RVTMSRDTSKNQFSLKLSSVTAADTAVYYCAR (SEQ ID NO: 6045) | GNWHYFDY (SEQ ID NO: 6009) | WGQGTLVTVSS (SEQ ID NO: 6046) |
| 15H6-HC_3 | EIQLLESGGGLVQPGGSLRLSCAVSGFSINTG (SEQ ID NO: 7373) | GYHWN (SEQ ID NO: 7313) | WVRQAPGKGLEWVG (SEQ ID NO: 6048) | YIYSSGTTRYNPSLKS (SEQ ID NO: 6008) | RFTISRDTSKNTFYLQMNSLRAEDTAVYYCAR (SEQ ID NO: 6049) | GNWHYFDY (SEQ ID NO: 6009) | WGQGTLVTVSS (SEQ ID NO: 6050) |
| 15H6-HC_4 | QIQLVESGGGLVKPGGSLRLSCAVSGFSINTG (SEQ ID NO: 7377) | GYHWN (SEQ ID NO: 7313) | WIRQAPGKGLEWVG (SEQ ID NO: 6052) | YIYSSGTTRYNPSLKS (SEQ ID NO: 6008) | RFTISRDTAKNSFYLQMNSLRAEDTAVYYCAR (SEQ ID NO: 6053) | GNWHYFDY (SEQ ID NO: 6009) | WGQGTLVTVSS (SEQ ID NO: 6054) |
| 15H6-HC_5 | QIQLVQSGAEVKKPGASVKVSCKVSGFSINTG (SEQ ID NO: 7376) | GYHWN (SEQ ID NO: 7313) | WVRQAPGQGLEWMG (SEQ ID NO: 6056) | YIYSSGTTRYNPSLKS (SEQ ID NO: 6008) | RVTMTRDTSTNTFYMELSSLRSEDTAVYYCAR (SEQ ID NO: 6057) | GNWHYFDY (SEQ ID NO: 6009) | WGQGTLVTVSS (SEQ ID NO: 6058) |
| 15H6-HC_6 | EIQLVQSGAEVKKPGATVKISCKVSGFSINTG (SEQ ID NO: 7378) | GYHWN (SEQ ID NO: 7313) | WVQQAPGKGLEWMG (SEQ ID NO: 6060) | YIYSSGTTRYNPSLKS (SEQ ID NO: 6008) | RVTITRDTSTNTFYMELSSLRSEDTAVYYCAR (SEQ ID NO: 6061) | GNWHYFDY (SEQ ID NO: 6009) | WGQGTLVTVSS (SEQ ID NO: 6062) |
| 9D9-HC | QIQLQESGPGLVKPSQSLSLSCSVTGFSINTG (SEQ ID NO: 7312) | GYHWN (SEQ ID NO: 7313) | WIRQFPGKKVEWMG (SEQ ID NO: 7314) | YIYSSGTTKYNPSLKS (SEQ ID NO: 7385) | RISITRDTSKNQFFLQLNSVTTEDTATYYCAR (SEQ ID NO: 6005) | GDWHYFDY (SEQ ID NO: 7315) | WGQGTMVAVSS (SEQ ID NO: 7316) |
| 3A12-HC | QIQLQESGPGLVKPSQSLSLTCSVTGFSINTG (SEQ ID NO: 7317) | GYHWN (SEQ ID NO: 7313) | WIRQFPGKKLEWMG (SEQ ID NO: 6004) | YIYSSGSTRYNPSLKS (SEQ ID NO: 7318) | RFSITRDTSKNQFFLQLNSVTTEDTATYYCTR (SEQ ID NO: 7319) | GNWHYFDY (SEQ ID NO: 6009) | WGQGTLVAVSS (SEQ ID NO: 6013) |

TABLE 21A-continued

Exemplary heavy chain CDRs and FWRs of NKp30-targeting antigen binding dom: (according to the Kabat numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| 12D10-HC | QIQLQESGPGLVKPSQSLSLTCSVTGFSINTG (SEQ ID NO: 7317) | GYHWN (SEQ ID NO: 7313) | WIRQFPGKKLEWMG (SEQ ID NO: 6004) | YIYSSGTTRYNPSLKS (SEQ ID NO: 6008) | RISITRDTSKNQFFLQLNSVTPEDTATYYCTR (SEQ ID NO: 6012) | GNWHYFDY (SEQ ID NO: 6009) | WGQGTLVAVSS (SEQ ID NO: 6013) |
| 15E1-HC | QIQLQESGPGLVKPSQSLSLSCSVTGFSITTT (SEQ ID NO: 7322) | GYHWN (SEQ ID NO: 7313) | WIRQFPGKKLEWMG (SEQ ID NO: 6004) | YIYSSGSTSYNPSLKS (SEQ ID NO: 6001) | RFSITRDTSKNQFFLQLNSVTTEDTATYYCAR (SEQ ID NO: 7323) | GDWHYFDY (SEQ ID NO: 7315) | WGPGTMVTVSS (SEQ ID NO: 7324) |
| 15E1 Humanized variant_VH1 | QIQLQESGPGLVKPSQTLSLTCTVSGFSITTT (SEQ ID NO: 7330) | GYHWN (SEQ ID NO: 7313) | WIRQHPGKGLEWIG (SEQ ID NO: 6019) | YIYSSGSTSYNPSLKS (SEQ ID NO: 6001) | LVTISRDTSKNQFSLKLSSVTAADTAVYYCAR (SEQ ID NO: 6020) | GDWHYFDY (SEQ ID NO: 7315) | WGQGTMVTVSS (SEQ ID NO: 6006) |
| 15E1 Humanized variant_VH2 | QIQLVESGGGLVKPGGSLRLSCAVSGFSITTT (SEQ ID NO: 7331) | GYHWN (SEQ ID NO: 7313) | WIRQAPGKGLEWVG (SEQ ID NO: 6052) | YIYSSGSTSYNPSLKS (SEQ ID NO: 6001) | RFTISRDTAKNSFYLQMNSLRAEDTAVYYCAR (SEQ ID NO: 6033) | GDWHYFDY (SEQ ID NO: 7315) | WGQGTMVTVSS (SEQ ID NO: 6006) |
| 15E1 Humanized variant_VH3 | EIQLLESGGGLVQPGGSLRLSCAVSGFSITTT (SEQ ID NO: 7332) | GYHWN (SEQ ID NO: 7313) | WVRQAPGKGLEWVG (SEQ ID NO: 6023) | YIYSSGSTSYNPSLKS (SEQ ID NO: 6001) | RFTISRDTSKNTFYLQMNSLRAEDTAVYYCAR (SEQ ID NO: 6024) | GDWHYFDY (SEQ ID NO: 7315) | WGQGTMVTVSS (SEQ ID NO: 6006) |
| 15E1 Humanized variant_VH4 | EIQLVESGGGLVQPGGSLRLSCAVSGFSITTT (SEQ ID NO: 7333) | GYHWN (SEQ ID NO: 7313) | WVRQAPGKGLEWVG (SEQ ID NO: 6023) | YIYSSGSTSYNPSLKS (SEQ ID NO: 6001) | RFTISRDTAKNSFYLQMNSLRAEDTAVYYCAR (SEQ ID NO: 6033) | GDWHYFDY (SEQ ID NO: 7315) | WGQGTMVTVSS (SEQ ID NO: 6006) |
| 15E1 Humanized variant_VH5 | QIQLVQSGAEVKKPGASVKVSCKVSGFSITTT (SEQ ID NO: 7334) | GYHWN (SEQ ID NO: 7313) | WVRQAPGQGLEWMG (SEQ ID NO: 6027) | YIYSSGSTSYNPSLKS (SEQ ID NO: 6001) | RVTMTRDTSTNTFYMELSSLRSEDTAVYYCAR (SEQ ID NO: 6037) | GDWHYFDY (SEQ ID NO: 7315) | WGQGTMVTVSS (SEQ ID NO: 6006) |

TABLE 21B

Exemplary heavy chain CDRs and FWRs of NKp30-targeting antigen binding domains of Table 21A (According to the ABM numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| 9G1-HC | QIQLQESGPGLVKPSQSLSLTCSVT (SEQ ID NO: 8581) | GFSINTGGYHWN (SEQ ID NO: 8582) | WIRQFPGKKLEWMG (SEQ ID NO: 6004) | YIYSSGSTSYNPSLKS (SEQ ID NO: 6001) | RISITRDTSKNQFFLQLNSVTTEDTATYYCAR (SEQ ID NO: 6005) | GNWHYFDF (SEQ ID NO: 6002) | WGQGTMVTVSS (SEQ ID NO: 6006) |
| 15H6-HC | QIQLQESGPGLVKPSQSLSLTCSVT | GFSINTGGYHWN (SEQ ID | WIRQFPGKKLEWMG (SEQ | YIYSSGTTRYNPSLKS | RISITRDTSKNQFFLQLNSVTPEDT | GNWHYFDY (SEQ ID NO: | WGQGTLVAVSS (SEQ ID |

TABLE 21B-continued

Exemplary heavy chain CDRs and FWRs of NKp30-targeting antigen binding domains of Table 21A (According to the ABM numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| | (SEQ ID NO: 8583) | NO: 8584) | ID NO: 6011) | (SEQ ID NO: 6008) | ATYYCTR (SEQ ID NO: 6012) | 6009) | NO: 6013) |
| 9G1-HC 1 | QIQLQESGP GLVKPSET LSLTCTVS (SEQ ID NO: 8585) | GFSINTG GYHWN (SEQ ID NO: 8586) | WIRQPA GKGLEW IG (SEQ ID NO: 6015) | YIYSSGS TSYNPS LKS (SEQ ID NO: 6001) | RVTMSRD TSKNQFSL KLSSVTAA DTAVYYC AR (SEQ ID NO: 6016) | GNWHYF DF (SEQ ID NO: 6002) | WGQGT MVTVSS (SEQ ID NO: 6017) |
| 9G1-HC 2 | QIQLQESGP GLVKPSQT LSLTCTVS (SEQ ID NO: 8587) | GFSINTG GYHWN (SEQ ID NO: 8588) | WIRQHP GKGLEW IG (SEQ ID NO: 6019) | YIYSSGS TSYNPS LKS (SEQ ID NO: 6001) | LVTISRDT SKNQFSLK LSSVTAAD TAVYYCA R (SEQ ID NO: 6020) | GNWHYF DF (SEQ ID NO: 6002) | WGQGT MVTVSS (SEQ ID NO: 6021) |
| 9G1-HC 3 | EIQLLESGG GLVQPGGS LRLSCAVS (SEQ ID NO: 8589) | GFSINTG GYHWN (SEQ ID NO: 8590) | WVRQAP GKGLEW VG (SEQ ID NO: 6023) | YIYSSGS TSYNPS LKS (SEQ ID NO: 6001) | RFTISRDTS KNTFYLQ MNSLRAE DTAVYYC AR (SEQ ID NO: 6024) | GNWHYF DF (SEQ ID NO: 6002) | WGQGT MVTVSS (SEQ ID NO: 6025) |
| 9G1-HC 4 | QIQLVQSG AEVKKPGS SVKVSCKV S (SEQ ID NO: 8591) | GFSINTG GYHWN (SEQ ID NO: 8592) | WVRQAP GQGLEW MG (SEQ ID NO: 6027) | YIYSSGS TSYNPS LKS (SEQ ID NO: 6001) | RVTITRDT STNTFYME LSSLRSED TAVYYCA R (SEQ ID NO: 6028) | GNWHYF DF (SEQ ID NO: 6002) | WGQGT MVTVSS (SEQ ID NO: 6029) |
| 9G1-HC 5 | EIQLVESG GGLVQPGG SLRLSCAV S (SEQ ID NO: 8593) | GFSINTG GYHWN (SEQ ID NO: 8594) | WVRQAP GKGLEW VG (SEQ ID NO: 6032) | YIYSSGS TSYNPS LKS (SEQ ID NO: 6001) | RFTISRDT AKNSFYL QMNSLRA EDTAVYY CAR (SEQ ID NO: 6033) | GNWHYF DF (SEQ ID NO: 6002) | WGQGT MVTVSS (SEQ ID NO: 6034) |
| 9G1-HC 6 | QIQLVQSG AEVKKPGA SVKVSCKV S (SEQ ID NO: 8595) | GFSINTG GYHWN (SEQ ID NO: 8596) | WVRQAP GQGLEW MG (SEQ ID NO: 6036) | YIYSSGS TSYNPS LKS (SEQ ID NO: 6001) | RVTMTRD TSTNTFYM ELSSLRSE DTAVYYC AR (SEQ ID NO: 6037) | GNWHYF DF (SEQ ID NO: 6002) | WGQGT MVTVSS (SEQ ID NO: 6038) |
| 15H6-HC 1 | QIQLQESGP GLVKPSQT LSLTCTVS (SEQ ID NO: 8597) | GFSINTG GYHWN (SEQ ID NO: 8598) | WIRQHP GKGLEW IG (SEQ ID NO: 6040) | YIYSSGT TRYNPS LKS (SEQ ID NO: 6008) | LVTISRDT SKNQFSLK LSSVTAAD TAVYYCA R (SEQ ID NO: 6041) | GNWHYF DY (SEQ ID NO: 6009) | WGQGTL VTVSS (SEQ ID NO: 6042) |
| 15H6-HC 2 | QIQLQESGP GLVKPSET LSLTCTVS (SEQ ID NO: 8599) | GFSINTG GYHWN (SEQ ID NO: 8600) | WIRQPA GKGLEW IG (SEQ ID NO: 6044) | YIYSSGT TRYNPS LKS (SEQ ID NO: 6008) | RVTMSRD TSKNQFSL KLSSVTAA DTAVYYC AR (SEQ ID NO: 6045) | GNWHYF DY (SEQ ID NO: 6009) | WGQGTL VTVSS (SEQ ID NO: 6046) |
| 15H6-HC 3 | EIQLLESGG GLVQPGGS LRLSCAVS (SEQ ID NO: 8601) | GFSINTG GYHWN (SEQ ID NO: 8602) | WVRQAP GKGLEW VG (SEQ ID NO: 6048) | YIYSSGT TRYNPS LKS (SEQ ID NO: 6008) | RFTISRDTS KNTFYLQ MNSLRAE DTAVYYC AR (SEQ ID NO: 6049) | GNWHYF DY (SEQ ID NO: 6009) | WGQGTL VTVSS (SEQ ID NO: 6050) |
| 15H6-HC_4 | QIQLVESG GGLVKPGG | GFSINTG GYHWN | WIRQAP GKGLEW | YIYSSGT TRYNPS | RFTISRDT AKNSFYL | GNWHYF DY (SEQ | WGQGTL VTVSS |

TABLE 21B-continued

Exemplary heavy chain CDRs and FWRs of NKp30-targeting antigen binding domains of Table 21A (According to the ABM numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| | SLRLSCAVS (SEQ ID NO: 8603) | (SEQ ID NO: 8604) | VG (SEQ ID NO: 6052) | LKS (SEQ ID NO: 6008) | QMNSLRAEDTAVYYCAR (SEQ ID NO: 6053) | ID NO: 6009) | (SEQ ID NO: 6054) |
| 15H6-HC 5 | QIQLVQSGAEVKKPGASVKVSCKVS (SEQ ID NO: 8605) | GFSINTGGYHWN (SEQ ID NO: 8606) | WVRQAPGQGLEWMG (SEQ ID NO: 6056) | YIYSSGTTRYNPSLKS (SEQ ID NO: 6008) | RVTMTRDTSTNTFYMELSSLRSEDTAVYYCAR (SEQ ID NO: 6057) | GNWHYFDY (SEQ ID NO: 6009) | WGQGTLVTVSS (SEQ ID NO: 6058) |
| 15H6-HC 6 | EIQLVQSGAEVKKPGATVKISCKVS (SEQ ID NO: 8607) | GFSINTGGYHWN (SEQ ID NO: 8608) | WVQQAPGKGLEWMG (SEQ ID NO: 6060) | YIYSSGTTRYNPSLKS (SEQ ID NO: 6008) | RVTITRDTSTNTFYMELSSLRSEDTAVYYCAR (SEQ ID NO: 6061) | GNWHYFDY (SEQ ID NO: 6009) | WGQGTLVTVSS (SEQ ID NO: 6062) |
| 9D9-HC | QIQLQESGPGLVKPSQSLSLSCSVT (SEQ ID NO: 8609) | GFSINTGGYHWN (SEQ ID NO: 8610) | WIRQFPGKKVEWMG (SEQ ID NO: 7314) | YIYSSGTTKYNPSLKS (SEQ ID NO: 7385) | RISITRDTSKNQFFLQLNSVTTEDTATYYCAR (SEQ ID NO: 6005) | GDWHYFDY (SEQ ID NO: 7315) | WGQGTMVAVSS (SEQ ID NO: 7316) |
| 3A12-HC | QIQLQESGPGLVKPSQSLSLTCSVT (SEQ ID NO: 8611) | GFSINTGGYHWN (SEQ ID NO: 8612) | WIRQFPGKKLEWMG (SEQ ID NO: 6004) | YIYSSGSTRYNPSLKS (SEQ ID NO: 7318) | RFSITRDTSKNQFFLQLNSVTTEDTATYYCTR (SEQ ID NO: 7319) | GNWHYFDY (SEQ ID NO: 6009) | WGQGTLVAVSS (SEQ ID NO: 6013) |
| 12D10-HC | QIQLQESGPGLVKPSQSLSLTCSVT (SEQ ID NO: 8613) | GFSINTGGYHWN (SEQ ID NO: 8614) | WIRQFPGKKLEWMG (SEQ ID NO: 6004) | YIYSSGTTRYNPSLKS (SEQ ID NO: 6008) | RISITRDTSKNQFFLQLNSVTPEDTATYYCTR (SEQ ID NO: 6012) | GNWHYFDY (SEQ ID NO: 6009) | WGQGTLVAVSS (SEQ ID NO: 6013) |
| 15E1-HC | QIQLQESGPGLVKPSQSLSLSCSVT (SEQ ID NO: 8615) | GFSITTTGYHWN (SEQ ID NO: 8616) | WIRQFPGKKLEWMG (SEQ ID NO: 6004) | YIYSSGSTSYNPSLKS (SEQ ID NO: 6001) | RFSITRDTSKNQFFLQLNSVTTEDTATYYCAR (SEQ ID NO: 7323) | GDWHYFDY (SEQ ID NO: 7315) | WGPGTMVTVSS (SEQ ID NO: 7324) |
| 15E1_Humanized variant_VH1 | QIQLQESGPGLVKPSQTLSLTCTVS (SEQ ID NO: 8617) | GFSITTTGYHWN (SEQ ID NO: 8618) | WIRQHPGKGLEWIG (SEQ ID NO: 6019) | YIYSSGSTSYNPSLKS (SEQ ID NO: 6001) | LVTISRDTSKNQFSLKLSSVTAADTAVYYCAR (SEQ ID NO: 6020) | GDWHYFDY (SEQ ID NO: 7315) | WGQGTMVTVSS (SEQ ID NO: 6006) |
| 15E1_Humanized variant_VH2 | QIQLVESGGGLVKPGGSLRLSCAVS (SEQ ID NO: 8619) | GFSITTTGYHWN (SEQ ID NO: 8620) | WIRQAPGKGLEWVG (SEQ ID NO: 6052) | YIYSSGSTSYNPSLKS (SEQ ID NO: 6001) | RFTISRDTAKNSFYLQMNSLRAEDTAVYYCAR (SEQ ID NO: 6033) | GDWHYFDY (SEQ ID NO: 7315) | WGQGTMVTVSS (SEQ ID NO: 6006) |
| 15E1_Humanized variant_VH3 | EIQLLESGGGLVQPGGSLRLSCAVS (SEQ ID NO: 8621) | GFSITTTGYHWN (SEQ ID NO: 8622) | WVRQAPGKGLEWVG (SEQ ID NO: 6023) | YIYSSGSTSYNPSLKS (SEQ ID NO: 6001) | RFTISRDTSKNTFYLQMNSLRAEDTAVYYCAR (SEQ ID NO: 6024) | GDWHYFDY (SEQ ID NO: 7315) | WGQGTMVTVSS (SEQ ID NO: 6006) |
| 15E1_Humanized variant_ | EIQLVESGGGLVQPGGSLRLSCAV | GFSITTTGYHWN (SEQ ID | WVRQAPGKGLEWVG (SEQ | YIYSSGSTSYNPSLKS | RFTISRDTAKNSFYLQMNSLRA | GDWHYFDY (SEQ ID NO: | WGQGTMVTVSS (SEQ ID |

TABLE 21B-continued

| Exemplary heavy chain CDRs and FWRs of NKp30-targeting antigen binding domains of Table 21A (According to the ABM numbering scheme) | | | | | | | |
|---|---|---|---|---|---|---|---|
| Ab ID | VHFWR1 | VHCDR1 | VHFWR2 | VHCDR2 | VHFWR3 | VHCDR3 | VHFWR4 |
| VH4 | S (SEQ ID NO: 8623) | NO: 8624) | ID NO: 6023) | (SEQ ID NO: 6001) | EDTAVYY CAR (SEQ ID NO: 6033) | 7315) | NO: 6006) |
| 15E1_ Humanized variant_ VH5 | QIQLVQSG AEVKKPGA SVKVSCKV S (SEQ ID NO: 8625) | GFSITTT GYHWN (SEQ ID NO: 8626) | WVRQAP GQGLEW MG (SEQ ID NO: 6027) | YIYSSGS TSYNPS LKS (SEQ ID NO: 6001) | RVTMTRD TSTNTFYM ELSSLRSE DTAVYYC AR (SEQ ID NO: 6037) | GDWHYF DY (SEQ ID NO: 7315) | WGQGT MVTVSS (SEQ ID NO: 6006) |

TABLE 22

| Exemplary light chain CDRs and FWRs of NKp30-targeting antigen binding domains | | | | | | | |
|---|---|---|---|---|---|---|---|
| Ab ID | VLFWR1 | VLCDR1 | VLFWR2 | VLCDR2 | VLFWR3 | VLCDR3 | VLFWR4 |
| 9G1-LC | SYTLTQPP LLSVALG HKATITC (SEQ ID NO: 6066) | SGERLS DKYVH (SEQ ID NO: 6063) | WYQQK PGRAPV MVIY (SEQ ID NO: 6067) | ENDKR PS (SEQ ID NO: 6064) | GIPDQFSGS NSGNIATLTI SKAQAGYE ADYYC (SEQ ID NO: 7292) | QSWDST NSAV (SEQ ID NO: 7293) | FGSGTQ LTVL (SEQ ID NO: 6069) |
| 15H6-LC | SYTLTQPP SLSVAPG QKATIIC (SEQ ID NO: 6073) | SGENLS DKYVH (SEQ ID NO: 6070) | WYQQK PGRAPV MVIY (SEQ ID NO: 6074) | ENEKRP S (SEQ ID NO: 6071) | GIPDQFSGS NSGNIATLTI SKAQPGSEA DYYC (SEQ ID NO: 6075) | HYWESI NSVV (SEQ ID NO: 6072) | FGSGTH LTVL (SEQ ID NO: 6076) |
| 9G1-LC_1 | QSVTTQPP SVSGAPG QRVTISC (SEQ ID NO: 6077) | SGERLS DKYVH (SEQ ID NO: 6063) | WYQQLP GTAPKM LIY (SEQ ID NO: 6078) | ENDKR PS (SEQ ID NO: 6064) | GVPDRFSGS NSGNSASLA ITGLQAEDE ADYYC (SEQ ID NO: 6079) | QSWDST NSAV (SEQ ID NO: 7293) | FGGGTQ LTVL (SEQ ID NO: 6080) |
| 9G1-LC_2 | QSVTTQPP SASGTPG QRVTISC (SEQ ID NO: 6081) | SGERLS DKYVH (SEQ ID NO: 6063) | WYQQLP GTAPKM LIY (SEQ ID NO: 6082) | ENDKR PS (SEQ ID NO: 6064) | GVPDRFSGS NSGNSASLA ISGLQSEDE ADYYC (SEQ ID NO: 6083) | QSWDST NSAV (SEQ ID NO: 7293) | FGGGTQ LTVL (SEQ ID NO: 6084) |
| 9G1-LC_3 | QSVTTQPP SASGTPG QRVTISC (SEQ ID NO: 6085) | SGERLS DKYVH (SEQ ID NO: 6063) | WYQQLP GTAPKM LIY (SEQ ID NO: 6086) | ENDKR PS (SEQ ID NO: 6064) | GVPDRFSGS NSGNSASLA ISGLRSEDEA DYYC (SEQ ID NO: 6087) | QSWDST NSAV (SEQ ID NO: 7293) | FGGGTQ LTVL (SEQ ID NO: 6088) |
| 9G1-LC_4 | SSETTQPH SVSVATA QMARITC (SEQ ID NO: 6089) | SGERLS DKYVH (SEQ ID NO: 6063) | WYQQK PGQDPV MVIY (SEQ ID NO: 6090) | ENDKR PS (SEQ ID NO: 6064) | GIPERFSGSN PGNTATLTIS RIEAGDEAD YYC (SEQ ID NO: 6091) | QSWDST NSAV (SEQ ID NO: 7293) | FGGGTQ LTVL (SEQ ID NO: 6092) |
| 9G1-LC_5 | DIQMTQSP STLSASVG DRVTITC (SEQ ID NO: 6093) | SGERLS DKYVH (SEQ ID NO: 6063) | WYQQK PGKAPK MLIY (SEQ ID NO: 6094) | ENDKR PS (SEQ ID NO: 6064) | GVPSRFSGS NSGNEATLT ISSLQPDDFA TYYC (SEQ ID NO: 6095) | QSWDST NSAV (SEQ ID NO: 7293) | FGQGTK VEIK (SEQ ID NO: 6096) |
| 15H6-LC_1 | QYVLTQP PSASGTPG | SGENLS DKYVH | WYQQLP GTAPKM | ENEKRP S (SEQ | GVPDRFSGS NSGNSASLA | HYWESI NSVV | FGEGTEL TVL |

TABLE 22-continued

Exemplary light chain CDRs and FWRs of NKp30-targeting antigen binding domains

| Ab ID | VLFWR1 | VLCDR1 | VLFWR2 | VLCDR2 | VLFWR3 | VLCDR3 | VLFWR4 |
|---|---|---|---|---|---|---|---|
| | QRVTISC (SEQ ID NO: 6097) | (SEQ ID NO: 6070) | LIY (SEQ ID NO: 6098) | ID NO: 6071) | ISGLQSEDE ADYYC (SEQ ID NO: 6099) | (SEQ ID NO: 6072) | (SEQ ID NO: 6100) |
| 15H6-LC_2 | QYVLTQP PSASGTPG QRVTISC (SEQ ID NO: 6101) | SGENLS DKYVH (SEQ ID NO: 6070) | WYQQLP GTAPKM LIY (SEQ ID NO: 6102) | ENEKRP S (SEQ ID NO: 6071) | GVPDRFSGS NSGNSASLA ISGLRSEDEA DYYC (SEQ ID NO: 6103) | HYWESI NSVV (SEQ ID NO: 6072) | FGEGTEL TVL (SEQ ID NO: 6104) |
| 15H6-LC_3 | SYELTQPP SVSVSPGQ TASITC (SEQ ID NO: 6105) | SGENLS DKYVH (SEQ ID NO: 6070) | WYQQK PGQSPV MVIY (SEQ ID NO: 6106) | ENEKRP S (SEQ ID NO: 6071) | GIPERFSGSN SGNTATLTIS GTQAMDEA DYYC (SEQ ID NO: 6107) | HYWESI NSVV (SEQ ID NO: 6072) | FGEGTEL TVL (SEQ ID NO: 6108) |
| 15H6-LC_4 | DYVLTQS PLSLPVTP GEPASISC (SEQ ID NO: 6109) | SGENLS DKYVH (SEQ ID NO: 6070) | WYLQKP GQSPQM LIY (SEQ ID NO: 6110) | ENEKRP S (SEQ ID NO: 6071) | GVPDRFSGS NSGNDATLK ISRVEAEDV GVYYC (SEQ ID NO: 6111) | HYWESI NSVV (SEQ ID NO: 6072) | FGQGTK VEIK (SEQ ID NO: 6112) |
| 15H6-LC_5 | AYQLTQS PSSLSASV GDRVTITC (SEQ ID NO: 6113) | SGENLS DKYVH (SEQ ID NO: 6070) | WYQQK PGKAPK MLIY (SEQ ID NO: 6114) | ENEKRP S (SEQ ID NO: 6071) | GVPSRFSGS NSGNDATLT ISSLQPEDFA TYYC (SEQ ID NO: 6115) | HYWESI NSVV (SEQ ID NO: 6072) | FGQGTK VEIK (SEQ ID NO: 6116) |
| 15H6-LC_6 | EYVLTQSP ATLSVSPG ERATLSC (SEQ ID NO: 6117) | SGENLS DKYVH (SEQ ID NO: 6070) | WYQQK PGQAPR MLIY (SEQ ID NO: 6118) | ENEKRP S (SEQ ID NO: 6071) | GIPARFSGSN SGNEATLTIS SLQSEDFAV YYC (SEQ ID NO: 6119) | HYWESI NSVV (SEQ ID NO: 6072) | FGQGTK VEIK (SEQ ID NO: 6120) |
| 9D9-LC | SYTLTQPP LVSVALG QKATIIC (SEQ ID NO: 7320) | SGENLS DKYVH (SEQ ID NO: 6070) | WYQQK PGRAPV MVIY (SEQ ID NO: 6067) | ENDKR PS (SEQ ID NO: 6064) | GIPDQFSGS NSGNIATLTI SKAQAGYE ADYYC (SEQ ID NO: 7292) | HCWDST NSAV (SEQ ID NO: 7321) | FGSGTH LTVL (SEQ ID NO: 6076) |
| 3A12-LC | SYTLTQPP LVSVALG QKATIIC (SEQ ID NO: 7320) | SGENLS DKYVH (SEQ ID NO: 6070) | WYQQK PGRAPV MVIY (SEQ ID NO: 6067) | ENDKR PS (SEQ ID NO: 6064) | GIPDQFSGS NSGNIATLTI SKAQAGYE ADYYC (SEQ ID NO: 7292) | HCWDST NSAV (SEQ ID NO: 7321) | FGSGTH LTVL (SEQ ID NO: 6076) |
| 12D10-LC | SYTLTQPP SLSVAPG QKATIIC (SEQ ID NO: 6073) | SGENLS DKYVH (SEQ ID NO: 6070) | WYQQK PGRAPV MVIY (SEQ ID NO: 6074) | ENEKRP S (SEQ ID NO: 6071) | GIPDQFSGS NSGNIATLTI SKAQPGSEA DYYC (SEQ ID NO: 6075) | HYWESI NSVV (SEQ ID NO: 6072) | FGSGTH LTVL (SEQ ID NO: 6076) |
| 15E1-LC | SFTLTQPP LVSVAVG QVATITC (SEQ ID NO: 7325) | SGEKLS DKYVH (SEQ ID NO: 7326) | WYQQK PGRAPV MVIY (SEQ ID NO: 6067) | ENDRR PS (SEQ ID NO: 7327) | GIPDQFSGS NSGNIASLTI SKAQAGDE ADYFC (SEQ ID NO: 7328) | QFWDST NSAV (SEQ ID NO: 7329) | FGGGTQ LTVL (SEQ ID NO: 6080) |
| 15E1_ Humanized variant_ VL1 | SSETTQPP SVSVSPGQ TASITC (SEQ ID NO: 7335) | SGEKLS DKYVH (SEQ ID NO: 7326) | WYQQK PGQSPV MVIY (SEQ ID NO: 6106) | ENDRR PS (SEQ ID NO: 7327) | GIPERFSGSN SGNTATLTIS GTQAMDEA DYFC (SEQ ID NO: 7336) | QFWDST NSAV (SEQ ID NO: 7329) | FGGGTQ LTVL (SEQ ID NO: 6080) |
| 15E1_ Humanized | SSETTQPH SVSVATA | SGEKLS DKYVH | WYQQK PGQDPV | ENDRR PS (SEQ | GIPERFSGSN PGNTATLTIS | QFWDST NSAV | FGGGTQ LTVL |

TABLE 22-continued

Exemplary light chain CDRs and FWRs of NKp30-targeting antigen binding domains

| Ab ID | VLFWR1 | VLCDR1 | VLFWR2 | VLCDR2 | VLFWR3 | VLCDR3 | VLFWR4 |
|---|---|---|---|---|---|---|---|
| variant_ VL2 | QMARITC (SEQ ID NO: 6089) | (SEQ ID NO: 7326) | MVIY (SEQ ID NO: 6090) | ID NO: 7327) | RIEAGDEAD YFC (SEQ ID NO: 7337) | (SEQ ID NO: 7329) | (SEQ ID NO: 6080) |
| 15E1_ Humanized variant_ VL3 | QSVTTQPP SASGTPG QRVTISC (SEQ ID NO: 6081) | SGEKLS DKYVH (SEQ ID NO: 7326) | WYQQLP GTAPKM LIY (SEQ ID NO: 6078) | ENDRR PS (SEQ ID NO: 7327) | GVPDRFSGS NSGNSASLA ISGLRSEDEA DYFC (SEQ ID NO: 7338) | QFWDST NSAV (SEQ ID NO: 7329) | FGGGTQ LTVL (SEQ ID NO: 6080) |
| 15E1_ Humanized variant_ VL4 | QSVTTQPP SVSGAPG QRVTISC (SEQ ID NO: 6077) | SGEKLS DKYVH (SEQ ID NO: 7326) | WYQQLP GTAPKM LIY (SEQ ID NO: 6078) | ENDRR PS (SEQ ID NO: 7327) | GVPDRFSGS NSGNSASLA ITGLQAEDE ADYFC (SEQ ID NO: 7339) | QFWDST NSAV (SEQ ID NO: 7329) | FGGGTQ LTVL (SEQ ID NO: 6080) |
| 15E1_ Humanized variant_ VL5 | DSVTTQSP LSLPVTLG QPASISC (SEQ ID NO: 7340) | SGEKLS DKYVH (SEQ ID NO: 7326) | WYQQRP GQSPRM LIY (SEQ ID NO: 7341) | ENDRR PS (SEQ ID NO: 7327) | GVPDRFSGS NSGNDATLK ISRVEAEDV GVYFC (SEQ ID NO: 7342) | QFWDST NSAV (SEQ ID NO: 7329) | FGGGTK VEIK (SEQ ID NO: 233) |

TABLE 23A

Exemplary heavy chain CDRs and FWRs of NKp30-targeting antigen binding domains

| Ab ID | VHFWR1 | VHCDR1 | VHFWR2 | VHCDR2 | VHFWR3 | VHCDR3 | VHFWR4 |
|---|---|---|---|---|---|---|---|
| BKM01 38 | EIQLLESG GGLVQPG GSLRLSCA VSGFS (SEQ ID NO: 8687) | ITTTGYH WN (SEQ ID NO: 8053) | WVRQAP GKGLEW VG (SEQ ID NO: 6023) | YIYSSGS TSYNPS LKS (SEQ ID NO: 6001) | RFTISRDTS KNTFYLQ MNSLRAE DTAVYYC AR (SEQ ID NO: 6024) | GDWHYF DY (SEQ ID NO: 7315) | WGQGT MVTVSS (SEQ ID NO: 6006) |
| BKM01 39 | EIQLLESG GGLVQPG GSLRISCA VSGFS (SEQ ID NO: 8687) | ITTTGYH WN (SEQ ID NO: 8053) | WVRQAP GKGLEW VG (SEQ ID NO: 6023) | YIYSSGS TSYNPS LKS (SEQ ID NO: 6001) | RFTISRDTS KNTFYLQ MNSLRAE DTAVYYC AR (SEQ ID NO: 6024) | GDWHYF DY (SEQ ID NO: 7315) | WGQGT MVTVSS (SEQ ID NO: 6006) |
| BKM01 40 | EIQLLESG GGLVQPG GSLRLSCA VSGFS SEQ ID NO: 8687) | ITTTGYH WN (SEQ ID NO: 8053) | WVRQAP GKGLEW VG (SEQ ID NO: 6023) | YIYSSGS TSYNPS LKS (SEQ ID NO: 6001) | RFTISRDTS KNTFYLQ MNSLRAE DTAVYYC AR (SEQ ID NO: 6024) | GDWHYF DY (SEQ ID NO: 7315) | WGQGT MVTVSS (SEQ ID NO: 6006) |
| BKM01 41 | EIQLLESG GGLVQPG GSLRLSCA VSGFS (SEQ ID NO: 8687) | TTTTGYH WN (SEQ ID NO: 8053) | WVRQAP GKGLEW VG (SEQ ID NO: 6023) | YTYSSGS TSYNPS LKS (SEQ ID NO: 6001) | RFTISRDTS KNTFYLQ MNSLRAE DTAVYYC AR (SEQ ID NO: 6024) | GDWHYF DY (SEQ ID NO: 7315) | WGQGT MVTVSS (SEQ ID NO: 6006) |
| BKM01 42 | EIQLLESG GGLVQPG GSLRLSCA VSGFS (SEQ ID NO: 8687) | ITTTGYH WN (SEQ ID NO: 8053) | WVRQAP GKGLEW VG (SEQ ID NO: 6023) | YIYSSGS TSYAPS LKS (SEQ ID NO: 8688) | RFTISRDTS KNTFYLQ MNSLRAE DTAVYYC AR (SEQ ID NO: 6024) | GDWHYF DY (SEQ ID NO: 7315) | WGQGT MVTVSS (SEQ ID NO: 6006) |
| BKM01 43 | EIQLLESG GGLVQPG GSLRLSCA VSGFS | ITTTGYH WN (SEQ ID NO: 8053) | WVRQAP GKGLEW VG (SEQ ID NO: | YIYSSGS TSYAPS LKS (SEQ ID | RFTISRDTS KNTFYLQ MNSLRAE DTAVYYC | GDWHYF DY (SEQ ID NO: 7315) | WGQGT MVTVSS (SEQ ID NO: 6006) |

TABLE 23A-continued

Exemplary heavy chain CDRs and FWRs of NKp30-targeting antigen binding domains

| Ab ID | VHFWR1 | VHCDR1 | VHFWR2 | VHCDR2 | VHFWR3 | VHCDR3 | VHFWR4 |
|---|---|---|---|---|---|---|---|
| | (SEQ ID NO: 8687) | | 6023) | NO: 8688) | AR (SEQ ID NO: 6024) | | |
| BKM0144 | EIQLLESGGGLVQPGGSLRLSCAVSGFS (SEQ ID NO: 8687) | ITTTGYHWN (SEQ ID NO: 8053) | WVRQAPGKGLEWVG (SEQ ID NO: 6023) | YTYSSGSTSYAPSLKS (SEQ ID NO: 8688) | RFTISRDTSKNTFYLQMNSLRAEDTAVYYCAR (SEQ ID NO: 6024) | GDWHYFDY (SEQ ID NO: 7315) | WGQGTMVTVSS (SEQ ID NO: 6006) |
| BKM0145 | EIQLLESGGGLVQPGGSLRLSCAVSGFS (SEQ ID NO: 8687) | ITTTGYHWN (SEQ ID NO: 8053) | WVRQAPGKGLEWVG (SEQ ID NO: 6023) | YIYSSGSTSYAPSLKS (SEQ ID NO: 8688) | RFTISRDTSKNTFYLQMNSLRAEDTAVYYCAR (SEQ ID NO: 6024) | GDWHYFDY (SEQ ID NO: 7315) | WGQGTMVTVSS (SEQ ID NO: 6006) |

TABLE 23B

Exemplary heavy chain CDRs and FWRs of NKp30-targeting antigen binding domains of Table 23A (According to the ABM numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| BKM 0138 | BIQLLESGGGLVQPGGSLRLSCAVS SEQ ID NO: 8627) | GFSITTTGYHWN (SEQ ID NO: 8628) | WVRQAPGKGLEWVG (SEQ ID NO: 6023) | YTYSSGSTSYNPSLKS (SEQ ID NO: 6001) | RFTISRDTSKNTFYLQMNSLRAEDTAVYYCAR (SEQ ID NO: 6024) | GDWHYFDY (SEQ ID NO: 7315) | WGQGTMVTVSS (SEQ ID NO: 6006) |
| BKM 0139 | EIQLLESGGGLVQPGGSLRLSCAVS (SEQ ID NO: 8629) | GFSITTTGYHWN (SEQ ID NO: 8630) | WVRQAPGKGLEWVG (SEQ ID NO: 6023) | YIYSSGSTSYNPSLKS (SEQ ID NO: 6001) | RFTISRDTSKNTFYLQMNSLRAEDTAVYYCAR (SEQ ID NO: 6024) | GDWHYFDY (SEQ ID NO: 7315) | WGQGTMVTVSS (SEQ ID NO: 6006) |
| BKM 0140 | EIQLLESGGGLVQPGGSLRLSCAVS SEQ ID NO: 8631) | GFSITTTGYHWN (SEQ ID NO: 8632) | WVRQAPGKGLEWVG (SEQ ID NO: 6023) | YIYSSGSTSYNPSLKS (SEQ ID NO: 6001) | RFTISRDTSKNTFYLQMNSLRAEDTAVYYCAR SEQ ID NO: 6024) | GDWHYFDY (SEQ ID NO: 7315) | WGQGTMVTVSS (SEQ ID NO: 6006) |
| BKM 0141 | EIOLLESGGGLVQPGGSLRLSCAVS SEQ ID NO: 8633) | GFSITTTGYHWN (SEQ ID NO: 8634) | WVRQAPGKGLEWVG (SEQ ID NO: 6023) | YIYSSGSTSYNPSLKS (SEQ ID NO: 6001) | RFTISRDTSKNTFYLQMNSLRAEDTAVYYCAR SEQ ID NO: 6024) | GDWHYFDY (SEQ ID NO: 7315) | WGQGTMVTVSS (SEQ ID NO: 6006) |
| BKM 0142 | EIQLLESGGGLVQPGGSLRLSCAVS (SEQ ID NO: 8635) | GFSITTTGYHWN (SEQ ID NO: 8636) | WVRQAPGKGLEWVG (SEQ ID NO: 6023) | YIYSSGSTSYAPSLKS (SEQ ID NO: 8688) | RFTISRDTSKNTFYLQMNSLRAEDTAVYYCAR (SEQ ID NO: 6024) | GDWHYFDY (SEQ ID NO: 7315) | WGQGTMVTVSS (SEQ ID NO: 6006) |
| BKM 0143 | EIQLLESGGGLVQPGGSLRLSCAVS (SEQ ID NO: 8637) | GFSITTTGYHWN SEQ ID NO: 8638) | WVRQAPGKGLEWVG (SEQ ID NO: 6023) | YIYSSGSTSYAPSLKS (SEQ ID NO: 8688) | RFTISRDTSKNTFYLQMNSLRAEDTAVYYCAR SEQ ID NO: 6024) | GDWHYFDY (SEQ ID NO: 7315) | WGQGTMVTVSS (SEQ ID NO: 6006) |
| BKM 0144 | EIQLLESGGGLVQPGGSLRLSCAVS | GFSITTTGYHWN (SEQ ID NO: 8640) | WVRQAPGKGLEWVG (SEQ ID NO: | YIYSSGSTSY APSLKS (SEQ ID NO: | RFTISRDTSKNTFYLQMNSLRAEDTAVYYCAR | GDWHYFDY (SEQ ID NO: | WGQGTMVTVSS (SEQ ID NO: |

TABLE 23B-continued

Exemplary heavy chain CDRs and FWRs of NKp30-targeting antigen binding domains of Table 23A (According to the ABM numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| | (SEQ ID NO: 8639) | | 6023) | 8688) | SEQ ID NO: 6024) | 7315) | 6006) |
| BKM 0145 | EIQLLES GGGLVQ PGGSLRL SCAVS SEQ ID NO: 8641) | GFSITTTG YHWN (SEQ ID NO: 8642) | WVRQAP GKGLEW VG (SEQ ID NO: 6023) | YIYSSGS TSYAPSL KS (SEQ ID NO: 8688) | RFTISRDTS KNTFYLQM NSLRAEDT AVYYCAR SEQ ID NO: 6024) | GDWHY FDY (SEQ ID NO: 7315) | WGQGT MVTVSS (SEQ ID NO: 6006) |

TABLE 24

Exemplary light chain CDRs and FWRs of NKp30-targeting antigen binding domains

| Ab ID | VLFWR1 | VLCDR1 | VLFWR2 | VLCDR2 | VLFWR3 | VLCDR3 | VLFWR4 |
|---|---|---|---|---|---|---|---|
| BKM0 138 | DSVTTQS PLSLPVT LGQPASI SC (SEQ ID NO: 7340) | SGEKLS DKYVH (SEQ ID NO: 7326) | WYQQRP GQSPRM LIY (SEQ ID NO: 7341) | ENDRRP S (SEQ ID NO: 7327) | GVPDRFSGS NSGNDATLK ISRVEAEDV GVYFC (SEQ ID NO: 7342) | QFWDST ASAV (SEQ ID NO: 8689) | FGGGTK VEIK (SEQ ID NO: 233) |
| BKM0 139 | DSVTTQS PLSLPVT LGQPASI SC (SEQ ID NO: 7340) | SGEKLS DKYVH (SEQ ID NO: 7326) | WYQQRP GQSPRM LIY (SEQ ID NO: 7341) | ENDRRP S (SEQ ID NO: 7327) | GVPDRESGS NSGNDATLK ISRVEAEDV GVYFC (SEQ ID NO: 7342) | QFWAST NSAV (SEQ ID NO: 8690) | FGGGTK VEIK SEQ ID NO: 233) |
| BKM0 140 | SSETTQP PSVSVSP GQTASIT C (SEQ ID NO: 7335) | SGEKLS DKYVH (SEQ ID NO: 7326) | WYQQK PGQSPV MVIY (SEQ ID NO: 6106) | ENDRRP S (SEQ ID NO: 7327) | GIPERFSGSN SGNTATLTIS GTQAMDEA DYFC (SEQ ID NO: 7336) | QFWAST NSAV (SEQ ID NO: 8690) | FGGGTQ LTVL (SEQ ID NO: 6080) |
| BKM0 141 | SSETTQP PSVSVSP GQTASIT C (SEQ ID NO: 7335) | SGEKLS DKYVH (SEQ ID NO: 7326) | WYQQK PGQSPV MVTY (SEQ ID NO: 6106) | ENDRRP S (SEQ ID NO: 7327) | GIPERFSGSN SGNTATLTIS GTQAMDEA DYFC (SEQ ID NO: 7336) | QFWDST ASAV SEQ ID NO: 8689) | FGGGTQ LTVL (SEQ ID NO: 6080) |
| BKM0 142 | DSVTTQS PLSLPVT LGQPASI SC (SEQ ID NO: 7340) | SGEKLS DKYVH (SEQ ID NO: 7326) | WYQQRP GQSPRM LIY (SEQ ID NO: 7341) | ENDRRP S (SEQ ID NO: 7327) | GVPDRFSGS NSGNDATLK ISRVEAEDV GVYFC (SEQ ID NO: 7342) | QFWDST NSAV (SEQ ID NO: 7329) | FGGGTK VEIK (SEQ ID NO: 233) |
| BKM0 143 | SSETTQP PSVSVSP GQTASIT C (SEQ ID NO: 7335) | SGEKLS DKYVH (SEQ ID NO: 7326) | WYQQK PGQSPV MVIY (SEQ ID NO: 6106) | ENDRRP S (SEQ ID NO: 7327) | GIPERFSGSN SGNTATLTIS GTQAMDEA DYFC (SEQ ID NO: 7336) | QFWDST NSAV (SEQ ID NO: 7329) | FGGGTQ LTVL (SEQ ID NO: 6080) |
| BKM0 144 | DSVTTQS PLSLPVT LGQPASI SC (SEQ ID NO: 7340) | SGEKLS DKYVH (SEQ ID NO: 7326) | WYQQRP GQSPRM LIY (SEQ ID NO: 7341) | ENDRRP S (SEQ ID NO: 7327) | GVPDRFSGS NSGNDATLK ISRVEAEDV GVYFC (SEQ ID NO: 7342) | QFWAST ASAV (SEQ ID NO: 8691) | FGGGTK VEIK (SEQ ID NO: 233) |
| BKM0 145 | SSETTQP PSVSVSP GQTASIT C (SEQ ID NO: 7335) | SGEKLS DKYVH SEQ ID NO: 7326) | WYQQK PGQSPV MVIY (SEQ ID NO: 6106) | ENDRRP S (SEQ ID NO: 7327) | GIPERFSGSN SGNTATLTIS GTQAMDEA DYFC (SEQ ID NO: 7336) | QFWAST ASAV (SEQ ID NO: 8691) | FGGGTQ LTVL (SEQ ID NO: 6080) |

TABLE 25

Exemplary variable regions of NKp30-targeting antigen binding domains

| SEQ ID NO | Ab ID | Description | Sequence |
|---|---|---|---|
| SEQ ID NO: 6121 | 9G1-HC | 9G1 heavy chain variable region | QIQLQESGPGLVKPSQSLSLTCSVTGFSINTGGYHWNWIRQFPGKKLEWMGYIYSSGSTSYNPSLKSRISITRDTSKNQFFLQLNSVTTEDTATYYCARGNWHYFDFWGQGTMVTVSS |
| SEQ ID NO: 6122 | 15H6-HC | 15H6 heavy chain variable region | QIQLQESGPGLVKPSQSLSLTCSVTGFSINTGGYHWNWIRQFPGKKLEWMGYIYSSGTTRYNPSLKSRISITRDTSKNQFFLQLNSVTPEDTATYYCTRGNWHYFDYWGQGTLVAVSS |
| SEQ ID NO: 6123 | 9G1-HC_1 | 9G1 heavy chain variable region humanized variant 1 | QIQLQESGPGLVKPSETLSLTCTVSGFSINTGGYHWNWIRQPAGKGLEWIGYIYSSGSTSYNPSLKSRVTMSRDTSKNQFSLKLSSVTAADTAVYYCARGNWHYFDFWGQGTMVTVSS |
| SEQ ID NO: 6124 | 9G1-HC_2 | 9G1 heavy chain variable region humanized variant 2 | QIQLQESGPGLVKPSQTLSLTCTVSGFSINTGGYHWNWIRQHPGKGLEWIGYIYSSGSTSYNPSLKSLVTISRDTSKNQFSLKLSSVTAADTAVYYCARGNWHYFDFWGQGTMVTVSS |
| SEQ ID NO: 6125 | 9G1-HC_3 | 9G1 heavy chain variable region humanized variant 3 | EIQLLESGGGLVQPGGSLRLSCAVSGFSINTGGYHWNWVRQAPGKGLEWVGYIYSSGSTSYNPSLKSRFTISRDTSKNTFYLQMNSLRAEDTAVYYCARGNWHYFDFWGQGTMVTVSS |
| SEQ ID NO: 6126 | 9G1-HC_4 | 9G1 heavy chain variable region humanized variant 4 | QIQLVQSGAEVKKPGSSVKVSCKVSGFSINTGGYHWNWVRQAPGQGLEWMGYIYSSGSTSYNPSLKSRVTITRDTSTNTFYMELSSLRSEDTAVYYCARGNWHYFDFWGQGTMVTVSS |
| SEQ ID NO: 6127 | 9G1-HC_5 | 9G1 heavy chain variable region humanized variant 5 | EIQLVESGGGLVQPGGSLRLSCAVSGFSINTGGYHWNWVRQAPGKGLEWVGYIYSSGSTSYNPSLKSRFTISRDTAKNSFYLQMNSLRAEDTAVYYCARGNWHYFDFWGQGTMVTVSS |
| SEQ ID NO: 6128 | 9G1-HC_6 | 9G1 heavy chain variable region humanized variant 6 | QIQLVQSGAEVKKPGASVKVSCKVSGFSINTGGYHWNWVRQAPGQGLEWMGYIYSSGSTSYNPSLKSRVTMTRDTSTNTFYMELSSLRSEDTAVYYCARGNWHYFDFWGQGTMVTVSS |
| SEQ ID NO: 6129 | 15H6-HC_1 | 15H6 heavy chain variable region humanized variant 1 | QIQLQESGPGLVKPSQTLSLTCTVSGFSINTGGYHWNWIRQHPGKGLEWIGYIYSSGTTRYNPSLKSLVTISRDTSKNQFSLKLSSVTAADTAVYYCARGNWHYFDYWGQGTLVTVSS |
| SEQ ID NO: 6130 | 15H6-HC_2 | 15H6 heavy chain variable region humanized variant 2 | QIQLQESGPGLVKPSETLSLTCTVSGFSINTGGYHWNWIRQPAGKGLEWIGYIYSSGTTRYNPSLKSRVTMSRDTSKNQFSLKLSSVTAADTAVYYCARGNWHYFDYWGQGTLVTVSS |
| SEQ ID NO: 6131 | 15H6-HC_3 | 15H6 heavy chain variable region humanized variant 3 | EIQLLESGGGLVQPGGSLRLSCAVSGFSINTGGYHWNWVRQAPGKGLEWVGYIYSSGTTRYNPSLKSRFTISRDTSKNTFYLQMNSLRAEDTAVYYCARGNWHYFDYWGQGTLVTVSS |
| SEQ ID NO: 6132 | 15H6-HC_4 | 15H6 heavy chain variable region humanized variant 4 | QIQLVESGGGLVKPGGSLRLSCAVSGFSINTGGYHWNWIRQAPGKGLEWVGYIYSSGTTRYNPSLKSRFTISRDTAKNSFYLQMNSLRAEDTAVYYCARGNWHYFDYWGQGTLVTVSS |
| SEQ ID NO: 6133 | 15H6-HC_5 | 15H6 heavy chain variable region humanized variant 5 | QIQLVQSGAEVKKPGASVKVSCKVSGFSINTGGYHWNWVRQAPGQGLEWMGYIYSSGTTRYNPSLKSRVTMTRDTSTNTFYMELSSLRSEDTAVYYCARGNWHYFDYWGQGTLVTVSS |
| SEQ ID NO: 6134 | 15H6-HC_6 | 15H6 heavy chain variable region humanized variant 6 | EIQLVQSGAEVKKPGATVKISCKVSGFSINTGGYHWNWVQQAPGKGLEWMGYIYSSGTTRYNPSLKSRVTITRDTSTNTFYMELSSLRSEDTAVYYCARGNWHYFDYWGQGTLVTVSS |

TABLE 25-continued

Exemplary variable regions of NKp30-targeting antigen binding domains

| SEQ ID NO | Ab ID | Description | Sequence |
|---|---|---|---|
| SEQ ID NO: 7294 | 9G1-LC | 9G1 light chain variable region | SYTLTQPPLLSVALGHKATITCSGERLSDKYVHWYQQKPGRAPVMVIYENDKRPSGIPDQFSGSNSGNIATLTISKAQAGYEADYYCQSWDSTNSAVFGSGTQLTVL |
| SEQ ID NO: 6136 | 15H6-LC | 15H6 light chain variable region | SYTLTQPPSLSVAPGQKATIICSGENLSDKYVHWYQQKPGRAPVMVIYENEKRPSGIPDQFSGSNSGNIATLTISKAQPGSEADYYCHYWESINSVVFGSGTHLTVL |
| SEQ ID NO: 6137 | 9G1-LC_1 | 9G1 light chain variable region humanized variant 1 | QSVTTQPPSVSGAPGQRVTISCSGERLSDKYVHWYQQLPGTAPKMLIYENDKRPSGVPDRFSGSNSGNSASLAITGLQAEDEADYYCQSWDSTNSAVFGGGTQLTVL |
| SEQ ID NO: 6138 | 9G1-LC_2 | 9G1 light chain variable region humanized variant 2 | QSVTTQPPSASGTPGQRVTISCSGERLSDKYVHWYQQLPGTAPKMLIYENDKRPSGVPDRFSGSNSGNSASLAISGLQSEDEADYYCQSWDSTNSAVFGGGTQLTVL |
| SEQ ID NO: 6139 | 9G1-LC_3 | 9G1 light chain variable region humanized variant 3 | QSVTTQPPSASGTPGQRVTISCSGERLSDKYVHWYQQLPGTAPKMLIYENDKRPSGVPDRFSGSNSGNSASLAISGLRSEDEADYYCQSWDSTNSAVFGGGTQLTVL |
| SEQ ID NO: 6140 | 9G1-LC_4 | 9G1 light chain variable region humanized variant 4 | SSETTQPHSVSVATAQMARITCSGERLSDKYVHWYQQKPGQDPVMVIYENDKRPSGIPERFSGSNPGNTATLTISRIEAGDEADYYCQSWDSTNSAVFGGGTQLTVL |
| SEQ ID NO: 6141 | 9G1-LC_5 | 9G1 light chain variable region humanized variant 5 | DIQMTQSPSTLSASVGDRVTITCSGERLSDKYVHWYQQKPGKAPKMLIYENDKRPSGVPSRFSGSNSGNEATLTISSLQPDDFATYYCQSWDSTNSAVFGQGTKVEIK |
| SEQ ID NO: 6142 | 15H6-LC_1 | 15H6 light chain variable region humanized variant 1 | QYVLTQPPSASGTPGQRVTISCSGENLSDKYVHWYQQLPGTAPKMLIYENEKRPSGVPDRFSGSNSGNSASLAISGLQSEDEADYYCHYWESINSVVFGEGTELTVL |
| SEQ ID NO: 6143 | 15H6-LC_2 | 15H6 light chain variable region humanized variant 2 | QYVLTQPPSASGTPGQRVTISCSGENLSDKYVHWYQQLPGTAPKMLIYENEKRPSGVPDRFSGSNSGNSASLAISGLRSEDEADYYCHYWESINSVVFGEGTELTVL |
| SEQ ID NO: 6144 | 15H6-LC_3 | 15H6 light chain variable region humanized variant 3 | SYELTQPPSVSVSPGQTASITCSGENLSDKYVHWYQQKPGQSPVMVIYENEKRPSGIPERFSGSNSGNTATLTISGTQAMDEADYYCHYWESINSVVFGEGTELTVL |
| SEQ ID NO: 6145 | 15H6-LC_4 | 15H6 light chain variable region humanized variant 4 | DYVLTQSPLSLPVTPGEPASISCSGENLSDKYVHWYLQKPGQSPQMLIYENEKRPSGVPDRFSGSNSGNDATLKISRVEAEDVGVYYCHYWESINSVVFGQGTKVEIK |
| SEQ ID NO: 6146 | 15H6-LC_5 | 15H6 light chain variable region humanized variant 5 | AYQLTQSPSSLSASVGDRVTITCSGENLSDKYVHWYQQKPGKAPKMLIYENEKRPSGVPSRFSGSNSGNDATLTISSLQPEDFATYYCHYWESINSVVFGQGTKVEIK |
| SEQ ID NO: 6147 | 15H6-LC_6 | 15H6 light chain variable region humanized variant 6 | EYVLTQSPATLSVSPGERATLSCSGENLSDKYVHWYQQKPGQAPRMLIYENEKRPSGIPARFSGSNSGNEATLTISSLQSEDFAVYYCHYWESINSVVFGQGTKVEIK |
| SEQ ID NO: 7295 | 9D9-HC | 9D9 heavy chain variable region | QIQLQESGPGLVKPSQSLSLSCSVTGFSINTGGYHWNWIRQFPGKKVEWMGYIYSSGTTKYNPSLKSRISITRDTSKNQFFLQLNSVTTEDTATYYCARGDWHYFDYWGQGTMVAVSS |
| SEQ ID NO: 7296 | 9D9-LC | 9D9 light chain variable region | SYTLTQPPLVSVALGQKATIICSGENLSDKYVHWYQQKPGRAPVMVIYENDKRPSGIPDQFSGSNSGNIATLTISKAQAGYEADYYCHCWDSTNSAVFGSGTHLTVL |

TABLE 25-continued

Exemplary variable regions of NKp30-targeting antigen binding domains

| SEQ ID NO | Ab ID | Description | Sequence |
|---|---|---|---|
| SEQ ID NO: 7297 | 3A12-HC | 3A12 heavy chain variable region | QIQLQESGPGLVKPSQSLSLTCSVTGFSINTGGYHWNWIRQFPGKKLEWMGYIYSSGSTRYNPSLKSRFSITRDTSKNQFFLQLNSVTTEDTATYYCTRGNWHYFDYWGQGTLVAVSS |
| SEQ ID NO: 7296 | 3A12-LC | 3A12 light chain variable region | SYTLTQPPLVSVALGQKATIICSGENLSDKYVHWYQQKPGRAPVMVIYENDKRPSGIPDQFSGSNSGNIATLTISKAQAGYEADYYCHCWDSTNSAVFGSGTHLTVL |
| SEQ ID NO: 6122 | 12D10-HC | 12D10 heavy chain variable region | QIQLQESGPGLVKPSQSLSLTCSVTGFSINTGGYHWNWIRQFPGKKLEWMGYIYSSGTTRYNPSLKSRISITRDTSKNQFFLQLNSVTPEDTATYYCTRGNWHYFDYWGQGTLVAVSS |
| SEQ ID NO: 6136 | 12D10-LC | 12D10 light chain variable region | SYTLTQPPSLSVAPGQKATIICSGENLSDKYVHWYQQKPGRAPVMVIYENEKRPSGIPDQFSGSNSGNIATLTISKAQPGSEADYYCHYWESINSVVFGSGTHLTVL |
| SEQ ID NO: 7298 | 15E1-HC | 15E1 heavy chain variable region | QIQLQESGPGLVKPSQSLSLSCSVTGFSITTTGYHWNWIRQFPGKKLEWMGYIYSSGSTSYNPSLKSRFSITRDTSKNQFFLQLNSVTTEDTATYYCARGDWHYFDYWGPGTMVTVSS |
| SEQ ID NO: 7299 | 15E1-LC | 15E1 light chain variable region | SFTLTQPPLVSVAVGQVATITCSGEKLSDKYVHWYQQKPGRAPVMVIYENDRRPSGIPDQFSGSNSGNIASLTISKAQAGDEADYFCQFWDSTNSAVFGGGTQLTVL |
| SEQ ID NO: 7300 | 15E1_ Humanized variant_ VH1 | 15E1 heavy chain variable region humanized variant 1 | QIQLQESGPGLVKPSQTLSLTCTVSGFSITTTGYHWNWIRQHPGKGLEWIGYIYSSGSTSYNPSLKSLVTISRDTSKNQFSLKLSSVTAADTAVYYCARGDWHYFDYWGQGTMVTVSS |
| SEQ ID NO: 7301 | 15E1_ Humanized variant_ VH2 | 15E1 heavy chain variable region humanized variant 2 | QIQLVESGGGLVKPGGSLRLSCAVSGFSITTTGYHWNWIRQAPGKGLEWVGYIYSSGSTSYNPSLKSRFTISRDTAKNSFYLQMNSLRAEDTAVYYCARGDWHYFDYWGQGTMVTVSS |
| SEQ ID NO: 7302 | 15E1_ Humanized variant_ VH3 (BJM0407 VH and BJM0411 VH) | 15E1 heavy chain variable region humanized variant 3 | EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSS |
| SEQ ID NO: 7303 | 15E1_ Humanized_ variant_ VH4 | 15E1 heavy chain variable region humanized variant 4 | EIQLVESGGGLVQPGGSLRLSCAVSGFSITTTGYHWNWVRQAPGKGLEWVGYIYSSGSTSYNPSLKSRFTISRDTAKNSFYLQMNSLRAEDTAVYYCARGDWHYFDYWGQGTMVTVSS |
| SEQ ID NO: 7304 | 15E1_ Humanized_ variant_ VH5 | 15E1 heavy chain variable region humanized variant 5 | QIQLVQSGAEVKKPGASVKVSCKVSGFSITTTGYHWNWVRQAPGQGLEWMGYIYSSGSTSYNPSLKSRVTMTRDTSTNTFYMELSSLRSEDTAVYYCARGDWHYFDYWGQGTMVTVSS |
| SEQ ID NO: 7305 | 15E1_ Humanized variant_ VL1 (BJM0407 VL) | 15E1 light chain variable region humanized variant 1 | SSETTQPPSVSVSPGQTASITCSGEKLSDKYVHWYQQKPGQSPVMVIYENDRRPSGIPERFSGSNSGNTATLTISGTQAMDEADYFCQFWDSTNSAVFGGGTQLTVL |
| SEQ ID NO: 7306 | 15E1_ Humanized variant_VL2 | 15E1 light chain variable region humanized variant 2 | SSETTQPHSVSVATAQMARITCSGEKLSDKYVHWYQQKPGQDPVMVIYENDRRPSGIPERFSGSNPGNTATLTISRIEAGDEADYFCQFWDSTNSAVFGGGTQLTVL |

TABLE 25-continued

Exemplary variable regions of NKp30-targeting antigen binding domains

| SEQ ID NO | Ab ID | Description | Sequence |
|---|---|---|---|
| SEQ ID NO: 7307 | 15E1_ Humanized variant_ VL3 | 15E1 light chain variable region humanized variant 3 | QSVTTQPPSASGTPGQRVTISCSGEKLSDKYVHWYQQLPGTAPKMLIYENDRRPSGVPDRFSGSNSGNSASLAISGLRSEDEADYFCQFWDSTNSAVFGGGTQLTVL |
| SEQ ID NO: 7308 | 15E1_ Humanized variant_ VL4 | 15E1 light chain variable region humanized variant 4 | QSVTTQPPSVSGAPGQRVTISCSGEKLSDKYVHWYQQLPGTAPKMLIYENDRRPSGVPDRFSGSNSGNSASLAITGLQAEDEADYFCQFWDSTNSAVFGGGTQLTVL |
| SEQ ID NO: 7309 | 15E1 Humanized variant VL5 (BJM0411 VL) | 15E1 light chain variable region humanized variant 5 | DSVTTQSPLSLPVTLGQPASISCSGEKLSDKYVHWYQQRPGQSPRMLIYENDRRPSGVPDRFSGSNSGNDATLKISRVEAEDVGVYFCQFWDSTNSAVFGGGTKVEIK |
| SEQ ID NO: 7302 | BKM0138 VH | BKM0138 heavy chain variable region | EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSS |
| SEQ ID NO: 7302 | BKM0139 VH | BKM0139 heavy chain variable region | EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSS |
| SEQ ID NO: 7302 | BKM0140 VH | BKM0140 heavy chain variable region | EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSS |
| SEQ ID NO: 7302 | BKM0141 VH | BKM0141 heavy chain variable region | EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSS |
| SEQ ID NO: 8692 | BKM0142 VH | BKM0142 heavy chain variable region | EIQLLESGGGLVQPGGSLRLSCAVSGFSITTTGYHWNWVRQAPGKGLEWVGYIYSSGSTSYAPSLKSRFTISRDTSKNTFYLQMNSLRAEDTAVYYCARGDWHYFDYWGQGTMVTVSS |
| SEQ ID NO: 8692 | BKM0143 VH | BKM0143 heavy chain variable region | EIQLLESGGGLVQPGGSLRLSCAVSGFSITTTGYHWNWVRQAPGKGLEWVGYIYSSGSTSYAPSLKSRFTISRDTSKNTFYLQMNSLRAEDTAVYYCARGDWHYFDYWGQGTMVTVSS |
| SEQ ID NO: 8692 | BKM0144 VH | BKM0144 heavy chain variable region | EIQLLESGGGLVQPGGSLRLSCAVSGFSITTTGYHWNWVRQAPGKGLEWVGYIYSSGSTSYAPSLKSRFTISRDTSKNTFYLQMNSLRAEDTAVYYCARGDWHYFDYWGQGTMVTVSS |
| SEQ ID NO: 8692 | BKM0145 VH | BKM0145 heavy chain variable region | EIQLLESGGGLVQPGGSLRLSCAVSGFSITTTGYHWNWVRQAPGKGLEWVGYIYSSGSTSYAPSLKSRFTISRDTSKNTFYLQMNSLRAEDTAVYYCARGDWHYFDYWGQGTMVTVSS |
| SEQ ID NO: 8693 | BKM0138 VL | BKM0138 light chain variable region | DSVTTQSPLSLPVTLGQPASISCSGEKLSDKYVHWYQQRPGQSPRMLIYENDRRPSGVPDRFSGSNSGNDATLKISRVEAEDVGVYFCQFWDSTASAVFGGGTKVEIK |
| SEQ ID NO: 8694 | BKM0139 VL | BKM0139 light chain variable region | DSVTTQSPLSLPVTLGQPASISCSGEKLSDKYVHWYQQRPGQSPRMLIYENDRRPSGVPDRFSGSNSGNDATLKISRVEAEDVGVYFCQFWASTNSAVFGGGTKVEIK |
| SEQ ID NO: 8695 | BKM0140 VL | BKM0140 light chain variable region | SSETTQPPSVSVSPGQTASITCSGEKLSDKYVHWYQQKPGQSPVMVIYENDRRPSGIPERFSGSNSGNTATLTISGTQAMDEADYFCQFWASTNSAVFGGGTQLTVL |
| SEQ ID NO: 8696 | BKM0141 VL | BKM0141 light chain variable region | SSETTQPPSVSVSPGQTASITCSGEKLSDKYVHWYQQKPGQSPVMVIYENDRRPSGIPERFSGSNSGNTATLTISGTQAMDEADYFCQFWDSTASAVFGGGTQLTVL |

TABLE 25-continued

Exemplary variable regions of NKp30-targeting antigen binding domains

| SEQ ID NO | Ab ID | Description | Sequence |
|---|---|---|---|
| SEQ ID NO: 7309 | BKM0142 VL | BKM0142 light chain variable region | DSVTTQSPLSLPVTLGQPASISCSGEKLSDKYVHWYQQRPGQSPRMLIYENDRRPSGVPDRFSGSNSGNDATLKISRVEAEDVGVYFCQFWDSTNSAVFGGGTKVEIK |
| SEQ ID NO: 7305 | BKM0143 VL | BKM0143 light chain variable region | SSETTQPPSVSVSPGQTASITCSGEKLSDKYVHWYQQKPGQSPVMVIYENDRRPSGIPERFSGSNSGNTATLTISGTQAMDEADYFCQFWDSTNSAVFGGGTQLTVL |
| SEQ ID NO: 8697 | BKM0144 VL | BKM0144 light chain variable region | DSVTTQSPLSLPVTLGQPASISCSGEKLSDKYVHWYQQRPGQSPRMLIYENDRRPSGVPDRFSGSNSGNDATLKISRVEAEDVGVYFCQFWASTASAVFGGGTKVEIK |
| SEQ ID NO: 8698 | BKM0145 VL | BKM0145 light chain variable region | SSETTQPPSVSVSPGQTASITCSGEKLSDKYVHWYQQKPGQSPVMVIYENDRRPSGIPERFSGSNSGNTATLTISGTQAMDEADYFCQFWASTASAVFGGGTQLTVL |

TABLE 26

Exemplary NKp30-targeting antigen binding domains/antibody molecules

| SEQ ID NO | Ab ID | Description | Sequence |
|---|---|---|---|
| SEQ ID NO: 6148 | Ch(anti-NKp30 9G1)HC N297A | 9G1 heavy chain | QIQLQESGPGLVKPSQSLSLTCSVTGFSINTGGYHWNWIRQFPGKKLEWMGYIYSSGSTSYNPSLKSRISITRDTSKNQFFLQLNSVTTEDTATYYCARGNWHYFDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK |
| SEQ ID NO: 6149 | Ch(anti-NKp30 9G1)HC | 9G1 heavy chain | QIQLQESGPGLVKPSQSLSLTCSVTGFSINTGGYHWNWIRQFPGKKLEWMGYIYSSGSTSYNPSLKSRISITRDTSKNQFFLQLNSVTTEDTATYYCARGNWHYFDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK |
| SEQ ID NO: 6150 | Ch(anti-NKp30 9G1)LC | 9G1 light chain | SYTLTQPPLLSVALGHKATITCSGERLSDKYVHWYQQKPGRAPVMVIYENDKRPSGIPDQFSGSNSGNIATLTISKAQAGYEADYYCQSWDSTNSAVFGSGTQLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS |
| SEQ ID NO: 6151 | Ch(anti-NKp30 15H6)HC N297A | 15H6 heavy chain | QIQLQESGPGLVKPSQSLSLTCSVTGFSINTGGYHWNWIRQFPGKKLEWMGYIYSSGTTRYNPSLKSRISITRDTSKNQFFLQLNSVTPEDTATYYCTRGNWHYFDYWGQGTLVAVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFN |

TABLE 26-continued

Exemplary NKp30-targeting antigen binding domains/antibody molecules

| SEQ ID NO | Ab ID | Description | Sequence |
|---|---|---|---|
| | | | WYVDGVEVHNAKTKPREEQYASTYRVVSVLTVL HQDWLNGKEYKCKVSNKALPAPIEKTISKAKGQP REPQVCTLPPSREEMTKNQVSLSCAVKGFYPSDIA VEWESNGQPENNYKTTPPVLDSDGSFFLVSKLTV DKSRWQQGNVFSCSVMHEALHNHYTQKSLSLSP GK |
| SEQ ID NO: 6152 | Ch(anti-NKp30 15H6)HC (hole) | 15H6 heavy chain | QIQLQESGPGLVKPSQSLSLTCSVTGFSINTGGYH WNWIRQFPGKKLEWMGYIYSSGTTRYNPSLKSRI SITRDTSKNQFFLQLNSVTPEDTATYYCTRGNWH YFDYWGQGTLVAVSSASTKGPSVFPLAPSSKSTSG GTAALGCLVKDYFPEPVTVSWNSGALTSGVHTFP AVLQSSGLYSLSSVVTVPSSSLGTQTYICNVNHKP SNTKVDKRVEPKSCDKTHTCPPCPAPELLGGPSVF LFPPKPKDTLMISRTPEVTCVVVDVSHEDPEVKFN WYVDGVEVHNAKTKPREEQYNSTYRVVSVLTVL HQDWLNGKEYKCKVSNKALPAPIEKTISKAKGQP REPQVCTLPPSREEMTKNQVSLSCAVKGFYPSDIA VEWESNGQPENNYKTTPPVLDSDGSFFLVSKLTV DKSRWQQGNVFSCSVMHEALHNHYTQKSLSLSP GK |
| SEQ ID NO: 6153 | Ch(anti-NKp30 15H6)LC | 15H6 light chain | SYTLTQPPSLSVAPGQKATIICSGENLSDKYVHWY QQKPGRAPVMVIYENEKRPSGIPDQFSGSNSGNIA TLTISKAQPGSEADYYCHYWESINSVVFGSGTHLT VLGQPKANPTVTLFPPSSEELQANKATLVCLISDF YPGAVTVAWKADGSPVKAGVETTKPSKQSNNKY AASSYLSLTPEQWKSHRSYSCQVTHEGSTVEKTV APTECS |
| SEQ ID NO: 6187 | anti-NKp30 9G1 scFv (VH-VL) | Hamster anti-NKp30 scFv of 9G1 in VH to VL orientation | QIQLQESGPGLVKPSQSLSLTCSVTGFSINTGGYH WNWIRQFPGKKLEWMGYIYSSGSTSYNPSLKSRIS ITRDTSKNQFFLQLNSVTTEDTATYYCARGNWHY FDFWGQGTMVTVSSGGGGSGGGGSGGGGSGGG GSSYTLTQPPLLSVALGHKATITCSGERLSDKYVH WYQQKPGRAPVMVIYENDKRPSGIPDQFSGSNSG NIATLTISKAQAGYEADYYCQSWDSTNSAVFGSG TQLTVL |
| SEQ ID NO: 6188 | anti-NKp30 9G1 scFv (VL-VH) | Hamster anti-NKp30 scFv of 9G1 in VL to VH orientation | SYTLTQPPLLSVALGHKATITCSGERLSDKYVHW YQQKPGRAPVMVIYENDKRPSGIPDQFSGSNSGNI ATLTISKAQAGYEADYYCQSWDSTNSAVFGSGTQ LTVLGGGGSGGGGSGGGGSGGGGSQIQLQESGPG LVKPSQSLSLTCSVTGFSINTGGYHWNWIRQFPGK KLEWMGYIYSSGSTSYNPSLKSRISITRDTSKNQFF LQLNSVTTEDTATYYCARGNWHYFDFWGQGTM VTVSS |
| SEQ ID NO: 6189 | anti-NKp30 15H6 scFv (VH-VL) | Hamster anti-NKp30 scFv of 15H6 in VH to VL orientation | QIQLQESGPGLVKPSQSLSLTCSVTGFSINTGGYH WNWIRQFPGKKLEWMGYIYSSGTTRYNPSLKSRI SITRDTSKNQFFLQLNSVTPEDTATYYCTRGNWH YFDYWGQGTLVAVSSGGGGSGGGGSGGGGSGG GGSSYTLTQPPSLSVAPGQKATIICSGENLSDKYV HWYQQKPGRAPVMVIYENEKRPSGIPDQFSGSNS GNIATLTISKAQPGSEADYYCHYWESINSVVFGSG THLTVL |
| SEQ ID NO: 6190 | anti-NKp30 15H6 scFv (VL-VH) | Hamster anti-NKp30 scFv of 15H6 in VL to VH orientation | SYTLTQPPSLSVAPGQKATIICSGENLSDKYVHWY QQKPGRAPVMVIYENEKRPSGIPDQFSGSNSGNIA TLTISKAQPGSEADYYCHYWESINSVVFGSGTHLT VLGGGGSGGGGSGGGGSGGGGSQIQLQESGPGLV KPSQSLSLTCSVTGFSINTGGYHWNWIRQFPGKKL EWMGYIYSSGTTRYNPSLKSRISITRDTSKNQFFLQ LNSVTPEDTATYYCTRGNWHYFDYWGQGTLVAV SS |
| SEQ ID NO: 7310 | BJM0859 lambda scFv | | EIQLLESGGGLVQPGGSLRLSCAVSGFSITTTGYH WNWVRQAPGKGLEWVGYIYSSGSTSYNPSLKSRF TISRDTSKNTFYLQMNSLRAEDTAVYYCARGDW HYFDYWGQGTMVTVSSGGGGSGGGGSGGGGSG GGGSSSETTQPPSVSVSPGQTASITCSGEKLSDKYV HWYQQKPGQSPVMVIYENDRRPSGIPERFSGSNS GNTATLTISGTQAMDEADYFCQFWDSTNSAVFGG GTQLTVL |

TABLE 26-continued

| Exemplary NKp30-targeting antigen binding domains/antibody molecules | | | |
|---|---|---|---|
| SEQ ID NO | Ab ID | Description | Sequence |
| SEQ ID NO: 7311 | BJM0860 kappa scFv | | EIQLLESGGGLVQPGGSLRLSCAVSGFSITTTGYH WNWVRQAPGKGLEWVGYIYSSGSTSYNPSLKSRF TISRDTSKNTFYLQMNSLRAEDTAVYYCARGDW HYFDYWGQGTMVTVSSGGGGSGGGGSGGGGSG GGGSDSVTTQSPLSLPVTLGQPASISCSGEKLSDK YVHWYQQRPGQSPRMLIYENDRRPSGVPDRFSGS NSGNDATLKISRVEAEDVGVYFCQFWDSTNSAVF GGGTKVEIK |
| SEQ ID NO: 8699 | BKM0138 scFv | | EIQLLESGGGLVQPGGSLRLSCAVSGFSITTTGYH WNWVRQAPGKGLEWVGYIYSSGSTSYNPSLKSRF TISRDTSKNTFYLQMNSLRAEDTAVYYCARGDW HYFDYWGQGTMVTVSSGGGGSGGGGSGGGGSG GGGSDSVTTQSPLSLPVTLGQPASISCSGEKLSDK YVHWYQQRPGQSPRMLIYENDRRPSGVPDRFSGS NSGNDATLKISRVEAEDVGVYFCQFWDSTASAVF GGGTKVEIK |
| SEQ ID NO: 8700 | BKM0139 scFv | | EIQLLESGGGLVQPGGSLRLSCAVSGFSITTTGYH WNWVRQAPGKGLEWVGYIYSSGSTSYNPSLKSRF TISRDTSKNTFYLQMNSLRAEDTAVYYCARGDW HYFDYWGQGTMVTVSSGGGGSGGGGSGGGGSG GGGSDSVTTQSPLSLPVTLGQPASISCSGEKLSDK YVHWYQQRPGQSPRMLIYENDRRPSGVPDRFSGS NSGNDATLKISRVEAEDVGVYFCQFWASTNSAVF GGGTKVEIK |
| SEQ ID NO: 8701 | BKM0140 scFv | | EIQLLESGGGLVQPGGSLRLSCAVSGFSITTTGYH WNWVRQAPGKGLEWVGYIYSSGSTSYNPSLKSRF TISRDTSKNTFYLQMNSLRAEDTAVYYCARGDW HYFDYWGQGTMVTVSSGGGGSGGGGSGGGGSG GGGSSSETTQPPSVSVSPGQTASITCSGEKLSDKYV HWYQQKPGQSPVMVIYENDRRPSGIPERFSGSNS GNTATLTISGTQAMDEADYFCQFWASTNSAVFGG GTQLTVL |
| SEQ ID NO: 8702 | BKM0141 scFv | | EIQLLESGGGLVQPGGSLRLSCAVSGFSITTTGYH WNWVRQAPGKGLEWVGYIYSSGSTSYNPSLKSRF TISRDTSKNTFYLQMNSLRAEDTAVYYCARGDW HYFDYWGQGTMVTVSSGGGGSGGGGSGGGGSG GGGSSSETTQPPSVSVSPGQTASITCSGEKLSDKYV HWYQQKPGQSPVMVIYENDRRPSGIPERFSGSNS GNTATLTISGTQAMDEADYFCQFWDSTASAVFGG GTQLTVL |
| SEQ ID NO: 8703 | BKM0142 scFv | | EIQLLESGGGLVQPGGSLRLSCAVSGFSITTTGYH WNWVRQAPGKGLEWVGYIYSSGSTSYAPSLKSRF TISRDTSKNTFYLQMNSLRAEDTAVYYCARGDW HYFDYWGQGTMVTVSSGGGGSGGGGSGGGGSG GGGSDSVTTQSPLSLPVTLGQPASISCSGEKLSDK YVHWYQQRPGQSPRMLIYENDRRPSGVPDRFSGS NSGNDATLKISRVEAEDVGVYFCQFWDSTNSAVF GGGTKVEIK |
| SEQ ID NO: 8704 | BKM0143 scFv | | EIQLLESGGGLVQPGGSLRLSCAVSGFSITTTGYH WNWVRQAPGKGLEWVGYIYSSGSTSYAPSLKSRF TISRDTSKNTFYLQMNSLRAEDTAVYYCARGDW HYFDYWGQGTMVTVSSGGGGSGGGGSGGGGSG GGGSSSETTQPPSVSVSPGQTASITCSGEKLSDKYV HWYQQKPGQSPVMVIYENDRRPSGIPERFSGSNS GNTATLTISGTQAMDEADYFCQFWDSTNSAVFGG GTQLTVL |
| SEQ ID NO: 8705 | BKM0144 scFv | | EIQLLESGGGLVQPGGSLRLSCAVSGFSITTTGYH WNWVRQAPGKGLEWVGYIYSSGSTSYAPSLKSRF TISRDTSKNTFYLQMNSLRAEDTAVYYCARGDW HYFDYWGQGTMVTVSSGGGGSGGGGSGGGGSG GGGSDSVTTQSPLSLPVTLGQPASISCSGEKLSDK YVHWYQQRPGQSPRMLIYENDRRPSGVPDRFSGS NSGNDATLKISRVEAEDVGVYFCQFWASTASAVF GGGTKVEIK |
| SEQ ID NO: 8706 | BKM0145 scFv | | EIQLLESGGGLVQPGGSLRLSCAVSGFSITTTGYH WNWVRQAPGKGLEWVGYIYSSGSTSYAPSLKSRF TISRDTSKNTFYLQMNSLRAEDTAVYYCARGDW |

TABLE 26-continued

Exemplary NKp30-targeting antigen binding domains/antibody molecules

| SEQ ID NO | Ab ID | Description | Sequence |
|---|---|---|---|
| | | | HYFDYWGQGTMVTVSSGGGGSGGGGSGGGGSG GGGSSSETTQPPSVSVSPGQTASITCSGEKLSDKYV HWYQQKPGQSPVMVIYENDRRPSGIPERFSGSNS GNTATLTISGTQAMDEADYFCQFWASTASAVFGG GTQLTVL |

In some embodiments, the NK cell engager is an antigen binding domain that binds to NKp46 (e.g., NKp46 present, e.g., expressed or displayed, on the surface of an NK cell) and comprises any CDR amino acid sequence, framework region (FWR) amino acid sequence, or variable region amino acid sequence disclosed in Table 27. In some embodiments, binding of the NK cell engager, e.g., antigen binding domain that binds to NKp46, to the NK cell activates the NK cell. An antigen binding domain that binds to NKp46 (e.g., NKp46 present, e.g., expressed or displayed, on the surface of an NK cell) may be said to target NKp46, the NK cell, or both.

In some embodiments, the NK cell engager is an antigen binding domain that binds to NKG2D (e.g., NKG2D present, e.g., expressed or displayed, on the surface of an NK cell) and comprises any CDR amino acid sequence, framework region (FWR) amino acid sequence, or variable region amino acid sequence disclosed in Table 27. In some embodiments, binding of the NK cell engager, e.g., antigen binding domain that binds to NKG2D, to the NK cell activates the NK cell. An antigen binding domain that binds to NKG2D (e.g., NKG2D present, e.g., expressed or displayed, on the surface of an NK cell) may be said to target NKG2D, the NK cell, or both.

In some embodiments, the NK cell engager is an antigen binding domain that binds to CD16 (e.g., CD16 present, e.g., expressed or displayed, on the surface of an NK cell) and comprises any CDR amino acid sequence, framework region (FWR) amino acid sequence, or variable region amino acid sequence disclosed in Table 27. In some embodiments, binding of the NK cell engager, e.g., antigen binding domain that binds to CD16, to the NK cell activates the NK cell. An antigen binding domain that binds to CD16 (e.g., CD16 present, e.g., expressed or displayed, on the surface of an NK cell) may be said to target CD16, the NK cell, or both.

TABLE 27

Exemplary variable regions of NKp46, NKG2D, or CD16-targeting antigen binding domains

| SEQ ID NO | Ab ID | Description | Sequence |
|---|---|---|---|
| SEQ ID NO: 6175 | NKG2D_ 1scFV | scFV that binds NKG2D | QVHLQESGPGLVKPSETLSLTCTVSDDSISSYYWSWI RQPPGKGLEWIGHISYSGSANYNPSLKSRVTISVDTS KNQFSLKLSSVTAADTAVYYCANWDDAFNIWGQGT MVTVSSGGGGSGGGGSGGGGSGGGGSEIVLTQSPGT LSLSPGERATLSCRASQSVSSSYLAWYQQKPGQAPR LLIYGASSRATGIPDRFSGSGSGTDFTLTISRLEPEDFA VYYCQQYGSSPWTFGQGTKVEIK |
| SEQ ID NO: 6176 | NKG2D_ 1VH | VH that binds NKG2D | QVHLQESGPGLVKPSETLSLTCTVSDDSISSYYWSWI RQPPGKGLEWIGHISYSGSANYNPSLKSRVTISVDTS KNQFSLKLSSVTAADTAVYYCANWDDAFNIWGQGT MVTVSS |
| SEQ ID NO: 6177 | NKG2D_ 1VL | VL that binds NKG2D | EIVLTQSPGTLSLSPGERATLSCRASQSVSSSYLAWY QQKPGQAPRLLIYGASSRATGIPDRFSGSGSGTDFTL TISRLEPEDFAVYYCQQYGSSPWTFGQGTKVEIK |
| SEQ ID NO: 6178 | NKG2D_ 2scFV | scFV that binds NKG2D | EVQLVQSGAEVKEPGESLKISCKNSGYSFTNYWVG WVRQMPGKGLEWMGIIYPGDSDTRYSPSFQGQVTIS ADKSINTAYLQWSSLKASDTAMYYCGRLTMFRGIII GYFDYWGQGTLVTVSSGGGGSGGGGSGGGGSGGG GSEIVLTQSPATLSLSPGERATLSCRASQSVSSYLAW YQQKPGQAPRLLIYDASNRATGIPARFSGSGSGTDFT LTISSLEPEDFAVYYCQQRSNWPWTFGQGTKVEIK |
| SEQ ID NO: 6179 | NKG2D_ 2VH | VH that binds NKG2D | EVQLVQSGAEVKEPGESLKISCKNSGYSFTNYWVG WVRQMPGKGLEWMGIIYPGDSDTRYSPSFQGQVTIS ADKSINTAYLQWSSLKASDTAMYYCGRLTMFRGIII GYFDYWGQGTLVTVSS |
| SEQ ID NO: 6180 | NKG2D_ 2VL | VL that binds NKG2D | EIVLTQSPATLSLSPGERATLSCRASQSVSSYLAWYQ QKPGQAPRLLIYDASNRATGIPARFSGSGSGTDFTLTI SSLEPEDFAVYYCQQRSNWPWTFGQGTKVEIK |
| SEQ ID NO: 6181 | NKp46scF V | scFV that binds NKp46 | QVQLQQSGPELVKPGASVKMSCKASGYTFTDYVIN WGKQRSGQGLEWIGEIYPGSGTNYYNEKFKAKATL TADKSSNIAYMQLSSLTSEDSAVYFCARRGRYGLYA MDYWGQGTSVTVSSGGGGSGGGGSGGGGSGGGGS DIQMTQTTSSLSASLGDRVTISCRASQDISNYLNWYQ |

TABLE 27-continued

Exemplary variable regions of NKp46, NKG2D, or CD16-targeting antigen binding domains

| SEQ ID NO | Ab ID | Description | Sequence |
|---|---|---|---|
| | | | QKPDGTVKLLIYYTSRLHSGVPSRFSGSGSGTDYSLTI NNLEQEDIATYFCQQGNTRPWTFGGGTKLEIK |
| SEQ ID NO: 6182 | NKp46VH | VH that binds NKp46 | QVQLQQSGPELVKPGASVKMSCKASGYTFTDYVIN WGKQRSGQGLEWIGEIYPGSGTNYYNEKFKAKATL TADKSSNIAYMQLSSLTSEDSAVYFCARRGRYGLYA MDYWGQGTSVTVSS |
| SEQ ID NO: 6183 | NKp46VL | VL that binds NKp46 | DIQMTQTTSSLSASLGDRVTISCRASQDISNYLNWYQ QKPDGTVKLLIYYTSRLHSGVPSRFSGSGSGTDYSLTI NNLEQEDIATYFCQQGNTRPWTFGGGTKLEIK |
| SEQ ID NO: 6184 | CD16scFV | scFV that binds CD16 | EVQLVESGG GVVRPGGSLR LSCAASGFTF DDYGMSWVRQ APGKGLEWVS GINWNGGSTG YADSVKGRFT ISRDNAKNSL YLQMNSLRAE DTAVYYCARG RSLLFDYWGQ GTLVTVSRGG GGSGGGGSGG GGSSELTQDP AVSVALGQTV RITCQGDSLR SYYASWYQQK PGQAPVLVIY GKNNRPSGIP DRFSGSSSGN TASLTITGAQ AEDEADYYCN SRDSSGNHVV FGGGTKLTVL |
| SEQ ID NO: 6185 | CD16VH | VH that binds CD16 | EVQLVESGG GVVRPGGSLR LSCAASGFTF DDYGMSWVRQ APGKGLEWVS GINWNGGSTG YADSVKGRFT ISRDNAKNSL YLQMNSLRAE DTAVYYCARG RSLLFDYWGQ GTLVTVSR |
| SEQ ID NO: 6186 | CD16VL | VL that binds CD16 | SSELTQDP AVSVALGQTVRITCQGDSLR SYYASWYQQK PGQAPVLVIY GKNNRPSGIP DRFSGSSSGNTASLTITGAQ AEDEADYYCN SRDSSGNHVV FGGGTKLTVL |

In one embodiment, the NK cell engager is a ligand of NKp30, e.g., is a B7-6, e.g., comprises the amino acid sequence of:

(SEQ ID NO: 7233)
DLKVEMMAGGTQITPLNDNVTIFCNIFYSQPLNITSMGITWFWKSLTFD

KEVKVFEFFGDHQEAFRPGAIVSPWRLKSGDASLRLPGIQLEEAGEYRC

EVVVTPLKAQGTVQLEVVASPASRLLLDQVGMKENEDKYMCESSGFYPE

AINITWEKQTQKFPHPIEISEDVITGPTIKNMDGTFNVTSCLKLNSSQE

DPGTVYQCVVRHASLHTPLRSNFTLTAARHSLSETEKTDNFS, a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7233.

In other embodiments, the NK cell engager is a ligand of NKp44 or NKp46, which is a viral HA. Viral hemagglutinins (HA) are glyco proteins which are on the surface of viruses. HA proteins allow viruses to bind to the membrane of cells via sialic acid sugar moieties which contributes to the fusion of viral membranes with the cell membranes (see e.g., Eur J Immunol. 2001 September; 31(9):2680-9 "Recognition of viral hemagglutinins by NKp44 but not by NKp30"; and Nature. 2001 Feb. 22; 409(6823):1055-60 "Recognition of haemagglutinins on virus-infected cells by NKp46 activates lysis by human NK cells" the contents of each of which are incorporated by reference herein).

In other embodiments, the NK cell engager is a ligand of NKG2D chosen from MICA, MICB, or ULBP1, e.g., wherein:

(i) MICA comprises the amino acid sequence:

(SEQ ID NO: 7234)
EPHSLRYNLTVLSWDGSVQSGFLTEVHLDGQPFLRCDRQKCRAKPQGQW

AEDVLGNKTWDRETRDLTGNGKDLRMTLAHIKDQKEGLHSLQEIRVCEI

HEDNSTRSSQHFYYDGELFLSQNLETKEWTMPQSSRAQTLAMNVRNFLK

EDAMKTKTHYHAMHADCLQELRRYLKSGVVLRRTVPPMVNVTRSEASEG

NITVTCRASGFYPWNITLSWRQDGVSLSHDTQQWGDVLPDGNGTYQTWV

ATRICQGEEQRFTCYMEHSGNHSTHPVPSGKVLVLQSHW, a fragment thereof or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7234;

(ii) MICB comprises the amino acid sequence:

(SEQ ID NO: 7235)
AEPHSLRYNLMVLSQDESVQSGFLAEGHLDGQPFLRYDRQKRRAKPQGQ

WAEDVLGAKTWDTETEDLTENGQDLRRTLTHIKDQKGGLHSLQEIRVCE

IHEDSSTRGSRHFYYDGELFLSQNLETQESTVPQSSRAQTLAMNVTNFW

KEDAMKTKTHYRAMQADCLQKLQRYLKSGVAIRRTVPPMVNVTCSEVSE

-continued

```
GNITVTCRASSFYPRNITLTWRQDGVSLSHNTQQWGDVLPDGNGTYQTW

VATRIRQGEEQRFTCYMEHSGNHGTHPVPSGKVLVLQSQRTD,
```

a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7235; or (iii) ULBP1 comprises the amino acid sequence:

```
                                           (SEQ ID NO: 7236)
GWVDTHCLCYDFIITPKSRPEPQWCEVQGLVDERPFLHYDCVNHKAKAF

ASLGKKVNVTKTWEEQTETLRDVVDFLKGQLLDIQVENLIPIEPLTLQA

RMSCEHEAHGHGRGSWQFLFNGQKFLLFDSNNRKWTALHPGAKKMTEKW

EKNRDVTMFFQKISLGDCKMWLEEFLMYWEQMLDPTKPPSLAPG,
```

a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7236.

In other embodiments, the NK cell engager is a ligand of DNAM1 chosen from NECTIN2 or NECL5, e.g., wherein:

(i) NECTIN2 comprises the amino acid sequence:

```
                                           (SEQ ID NO: 7237)
QDVRVQVLPEVRGQLGGTVELPCHLLPPVPGLYISLVTWQRPDAPANHQ

NVAAFHPKMGPSFPSPKPGSERLSFVSAKQSTGQDTEAELQDATLALHG

LTVEDEGNYTCEFATFPKGSVRGMTWLRVIAKPKNQAEAQKVTFSQDPT

TVALCISKEGRPPARISWLSSLDWEAKETQVSGTLAGTVTVTSRFTLVP

SGRADGVTVTCKVEHESFEEPALIPVTLSVRYPPEVSISGYDDNWYLGR

TDATLSCDVRSNPEPTGYDWSTTSGTFPTSAVAQGSQLVIHAVDSLFNT

TFVCTVTNAVGMGRAEQVIFVRETPNTAGAGATGG,
```

a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7237; or (ii) NECL5 comprises the amino acid sequence:

```
                                           (SEQ ID NO: 7238)
WPPPGTGDVVVQAPTQVPGFLGDSVTLPCYLQVPNMEVTHVSQLTWARH

GESGSMAVFHQTQGPSYSESKRLEFVAARLGAELRNASLRMFGLRVEDE

GNYTCLFVTFPQGSRSVDIWLRVLAKPQNTAEVQKVQLTGEPVPMARCV

STGGRPPAQITWHSDLGGMPNTSQVPGFLSGTVTVTSLWILVPSSQVDG

KNVTCKVEHESFEKPQLLTVNLTVYYPPEVSISGYDNNWYLGQNEATLT

CDARSNPEPTGYNWSTTMGPLPPFAVAQGAQLLIRPVDKPINTTLICNV

TNALGARQAELTVQVKEGPPSEHSGISRN,
```

a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7238.

In yet other embodiments, the NK cell engager is a ligand of DAP10, which is an adapter for NKG2D (see e.g., Proc Natl Acad Sci USA. 2005 May 24; 102(21): 7641-7646; and Blood, 15 Sep. 2011 Volume 118, Number 11, the full contents of each of which is incorporated by reference herein).

In other embodiments, the NK cell engager is a ligand of CD16, which is a CD16a/b ligand, e.g., a CD16a/b ligand further comprising an antibody Fc region (see e.g., Front Immunol. 2013; 4: 76 discusses how antibodies use the Fc to trigger NK cells through CD16, the full contents of which are incorporated herein).

In other embodiments, the NK cell engager is a ligand of CRTAM, which is NECL2, e.g., wherein NECL2 comprises the amino acid sequence:

```
                                           (SEQ ID NO: 7239)
QNLFTKDVTVIEGEVATISCQVNKSDDSVIQLLNPNRQTIYFRDFRPLK

DSRFQLLNFSSSELKVSLTNVSISDEGRYFCQLYTDPPQESYTTITVLV

PPRNLMIDIQKDTAVEGEEIEVNCTAMASKPATTIRWFKGNTELKGKSE

VEEWSDMYTVTSQLMLKVHKEDDGVPVICQVEHPAVTGNLQTQRYLEVQ

YKPQVHIQMTYPLQGLTREGDALELTCEAIGKPQPVMVTWVRVDDEMPQ

HAVLSGPNLFINNLNKTDNGTYRCEASNIVGKAHSDYMLYVYDPPTTIP

PPTTTTTTTTTTTTILTIITDSRAGEEGSIRAVDH,
```

a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7239.

In other embodiments, the NK cell engager is a ligand of CD27, which is CD70, e.g., wherein CD70 comprises the amino acid sequence:

```
                                           (SEQ ID NO: 7240)
QRFAQAQQQLPLESLGWDVAELQLNHTGPQQDPRLYWQGGPALGRSFLH

GPELDKGQLRIHRDGIYMVHIQVTLAICSSTTASRHHPTTLAVGICSPA

SRSISLLRLSFHQGCTIASQRLTPLARGDTLCTNLTGTLLPSRNTDETF

FGVQWVRP,
```

a fragment thereof or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7240.

In other embodiments, the NK cell engager is a ligand of PSGL1, which is L-selectin (CD62L), e.g., wherein L-selectin comprises the amino acid sequence:

```
                                           (SEQ ID NO: 7241)
WTYHYSEKPMNWQRARRFCRDNYTDLVAIQNKAEIEYLEKTLPFSRSYY

WIGIRKIGGIWTWVGTNKSLTEEAENWGDGEPNNKKNKEDCVEIYIKRN

KDAGKWNDDACHKLKAALCYTASCQPWSCSGHGECVEIINNYTCNCDVG
```

-continued

```
YYGPQCQFVIQCEPLEAPELGTMDCTHPLGNFSFSSQCAFSCSEGTNLT

GIEETTCGPFGNWSSPEPTCQVIQCEPLSAPDLGIMNCSHPLASFSFTS

ACTFICSEGTELIGKKKTICESSGIWSNPSPICQKLDKSFSMIKEGDYN,
```

a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7241.

In other embodiments, the NK cell engager is a ligand of CD96, which is NECL5, e.g., wherein NECL5 comprises the amino acid sequence:

```
                                        (SEQ ID NO: 7238)
WPPPGTGDVVVQAPTQVPGFLGDSVTLPCYLQVPNMEVTHVSQLTWARH

GESGSMAVFHQTQGPSYSESKRLEFVAARLGAELRNASLRMFGLRVEDE

GNYTCLFVTFPQGSRSVDIWLRVLAKPQNTAEVQKVQLTGEPVPMARCV

STGGRPPAQITWHSDLGGMPNTSQVPGFLSGTVTVTSLWILVPSSQVDG

KNVTCKVEHESFEKPQLLTVNLTVYYPPEVSISGYDNNWYLGQNEATLT

CDARSNPEPTGYNWSTTMGPLPPFAVAQGAQLLIRPVDKPINTTLICNV

TNALGARQAELTVQVKEGPPSEHSGISRN,
```

a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7238.

In other embodiments, the NK cell engager is a ligand of CD100 (SEMA4D), which is CD72, e.g., wherein CD72 comprises the amino acid sequence:

```
                                        (SEQ ID NO: 7242)
RYLQVSQQLQQTNRVLEVTNSSLRQQLRLKITQLGQSAEDLQGSRRELA

QSQEALQVEQRAHQAAEGQLQACQADRQKTKETLQSEEQQRRALEQKLS

NMENRLKPFFTCGSADTCCPSGWIMHQKSCFYISLTSKNWQESQKQCET

LSSKLATFSEIYPQSHSYYFLNSLLPNGGSGNSYWTGLSSNKDWKLTDD

TQRTRTYAQSSKCNKVHKTWSWWTLESESCRSSLPYICEMTAFRFPD,
```

a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7242.

In other embodiments, the NK cell engager is a ligand of NKp80, which is CLEC2B (AICL), e.g., wherein CLEC2B (AICL) comprises the amino acid sequence:

```
                                        (SEQ ID NO: 7243)
KLTRDSQSLCPYDWIGFQNKCYYFSKEEGDWNSSKYNCSTQHADLTIID

NIEEMNFLRRYKCSSDHWIGLKMAKNRTGQWVDGATFTKSFGMRGSEGC

AYLSDDGAATARCYTERKWICRKRIH,
```

a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7243.

In other embodiments, the NK cell engager is a ligand of CD244, which is CD48, e.g., wherein CD48 comprises the amino acid sequence: QGHLVHMTVVSGSNVTLNISESL-PENYKQLTWFYTFDQKIVEWDSRKSKY-FESKFKGRVRLDPQSG ALYISKVQKEDNSTY-IMRVLKKTGNEQEWKIKLQVLDPVPKPVIKIEKIED-MDDNCYLKLSCVIPGE SVNYTWYGDKRPFPKELQNSVLETTLMPH-NYSRCYTCQVSNSVSSKNGTVCLSPPCTLARS (SEQ ID NO: 7244), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7244.

In some embodiments, the NK cell engager is a viral hemagglutinin (HA), HA is a glycoprotein found on the surface of influenza viruses. It is responsible for binding the virus to cells with sialic acid on the membranes, such as cells in the upper respiratory tract or erythrocytes. HA has at least 18 different antigens. These subtypes are named H1 through H18. NCRs can recognize viral proteins. NKp46 has been shown to be able to interact with the HA of influenza and the HA-NA of Paramyxovirus, including Sendai virus and Newcastle disease virus. Besides NKp46, NKp44 can also functionally interact with HA of different influenza subtypes.

Death Receptor Signal Engagers

Death receptors, e.g., death receptors 4 and 5 (DR4 and DR5, also known as TRAIL-R1 and TRAIL-R2 respectively), are trimeric type I transmembrane proteins widely expressed in normal human tissues. Activation of death receptors causes intracellular signaling that induces cell death. TNF-related apoptosis-inducing ligand (TRAIL) (also known as Apo2L) is a trimeric protein that binds to Death receptors, activating their cell death-inducing signaling (Amarante-Mendes and Griffith. Pharmacol Ther. 2015 November; 155:117-31).

The present disclosure provides, inter alia, multispecific (e.g., bi-, tri-, quad-specific) or multifunctional molecules, that are engineered to contain one or more death receptor signal engagers that mediate binding to death receptors and/or activation of death receptor signaling on a target cell (e.g., a tumor antigen presenting cell (e.g., cancer cell, e.g., a lymphoma cell), or a lymphocyte expressing TRBC1 or TRBC2). Accordingly, in some embodiments, the death receptor signal engager comprises one or more TRAIL polypeptides or a fragment thereof (TRAIL molecule), one or more death receptors or a fragment thereof (death receptor molecule), or one or more antigen binding domains that specifically binds to a death receptor (e.g., and activates death receptor signaling). Without wishing to be bound by theory, it is thought that a death receptor signal engager that can activate death receptor signaling on a target cell can induce the death of the target cell, e.g., a target disease cell, e.g., a target cancer cell.

Death receptor signal engagers may comprise TRAIL molecules and/or death receptor molecules from or derived from versions of TRAIL and death receptors known to those skilled in the art. In some embodiments, the death receptor signal engager comprises a human TRAIL molecule or death receptor molecule. In some embodiments, the death receptor signal engager comprises a mouse TRAIL molecule or death receptor molecule. In some embodiments, the death receptor signal engager comprises a mammalian TRAIL molecule or death receptor molecule. In some embodiments, the death receptor signal engager comprises a truncated TRAIL molecule or death receptor molecule (e.g., relative to a wild-type TRAIL molecule or death receptor molecule).

In some embodiments, the death receptor signal engager comprises a truncated TRAIL molecule comprising at least residues corresponding to amino acids 95-281 of human TRAIL, e.g., a truncated TRAIL molecule comprising residues corresponding to amino acids 95-281 of human TRAIL. In some embodiments, the death receptor signal engager comprises a truncated TRAIL molecule comprising residues of 95-281 of human TRAIL.

In some embodiments, the death receptor signal engager comprises a truncated TRAIL molecule comprising at least residues corresponding to amino acids 122-281 of human TRAIL, e.g., a truncated TRAIL molecule comprising residues corresponding to amino acids 122-281 of human TRAIL. In some embodiments, the death receptor signal engager comprises a truncated TRAIL molecule comprising residues of 122-281 of human TRAIL.

In some embodiments, the death receptor signal engager comprises one, two, or three TRAIL molecules (e.g., the death receptor signal engager is a monomeric, dimeric, or trimeric TRAIL molecule, respectively). In some embodiments, the death receptor signal engager comprises one, two, or three death receptor molecules (e.g., the death receptor signal engager is a monomeric, dimeric, or trimeric death receptor molecule, respectively). In some embodiments, the death receptor signal engager comprises one, two, or three antigen binding domains that specifically bind to a death receptor (e.g., to one or more death receptors, e.g., the same or different death receptors)

In some embodiments, the death receptor signal engager comprises an amino acid sequence selected from Table 28 (or an amino acid sequence having at least about 77%, 80%, 85%, 90%, 95%, or 99% sequence identity to a sequence selected from Table 28).

In some embodiments, the death receptor signal engager comprises an amino acid sequence of SEQ ID NO: 6157 (or an amino acid sequence having at least about 77%, 80%, 85%, 90%, 95%, or 99% sequence identity to SEQ ID NO: 6157).

In some embodiments, the death receptor signal engager comprises an amino acid sequence of SEQ ID NO: 6158 (or an amino acid sequence having at least about 77%, 80%, 85%, 90%, 95%, or 99% sequence identity to SEQ ID NO: 6158).

In some embodiments, the death receptor signal engager comprises an amino acid sequence of SEQ ID NO: 6159 (or an amino acid sequence having at least about 77%, 80%, 85%, 90%, 95%, or 99% sequence identity to SEQ ID NO: 6159).

In some embodiments, the death receptor signal engager comprises an amino acid sequence of SEQ ID NO: 6160 (or an amino acid sequence having at least about 77%, 80%, 85%, 90%, 95%, or 99% sequence identity to SEQ ID NO: 6160).

In some embodiments, the death receptor signal engager comprises an amino acid sequence of SEQ ID NO: 6161 (or an amino acid sequence having at least about 77%, 80%, 85%, 90%, 95%, or 99% sequence identity to SEQ ID NO: 6161).

In some embodiments, the death receptor signal engager comprises an amino acid sequence of SEQ ID NO: 6162 (or an amino acid sequence having at least about 77%, 80%, 85%, 90%, 95%, or 99% sequence identity to SEQ ID NO: 6162).

In some embodiments, the death receptor signal engager comprises an amino acid sequence of SEQ ID NO: 6163 (or an amino acid sequence having at least about 77%, 80%, 85%, 90%, 95%, or 99% sequence identity to SEQ ID NO: 6163).

In some embodiments, the death receptor signal engager comprises an amino acid sequence of SEQ ID NO: 6164 (or an amino acid sequence having at least about 77%, 80%, 85%, 90%, 95%, or 99% sequence identity to SEQ ID NO: 6164).

In some embodiments, the death receptor signal engager comprises an amino acid sequence of SEQ ID NO: 6165 (or an amino acid sequence having at least about 77%, 80%, 85%, 90%, 95%, or 99% sequence identity to SEQ ID NO: 6165).

In some embodiments, the death receptor signal engager is comprised on the same polypeptide chain as another component of a multifunctional molecule of the present disclosure, e.g., the death receptor signal engager is comprised of the same polypeptide chain as a heavy and/or light chain of a first antigen binding domain that preferentially binds to a tumor antigen on a lymphoma cell (e.g., T cell), wherein the tumor antigen is T cell receptor beta chain constant domain 1 (TRBC1) or T cell receptor beta chain constant domain 2 (TRBC2), a heavy and/or light chain of a first antigen binding domain that selectively targets lymphocytes expressing T cell receptor beta chain constant domain 1 (TRBC1) or T cell receptor beta chain constant domain 2 (TRBC2), an immune cell engager, a cytokine molecule, or a stromal modified moiety, e.g., as a fusion protein. In some embodiments, the multifunctional molecule comprises a fusion protein comprising a death receptor signal engager and light chain of a first antigen binding domain that preferentially binds to a tumor antigen on a lymphoma cell (e.g., T cell), wherein the tumor antigen is T cell receptor beta chain constant domain 1 (TRBC1) or T cell receptor beta chain constant domain 2 (TRBC2). In some embodiments, the multifunctional molecule comprises a fusion protein comprising a death receptor signal engager and a light chain of a first antigen binding domain that selectively targets lymphocytes expressing T cell receptor beta chain constant domain 1 (TRBC1) or T cell receptor beta chain constant domain 2 (TRBC2).

In some embodiments, the fusion protein comprising a death receptor signal engager and a light chain of a first antigen binding domain targeting TRBC1 comprises an amino acid sequence of SEQ ID NO: 6170 (or an amino acid sequence having at least about 77%, 80%, 85%, 90%, 95%, or 99% sequence identity to SEQ ID NO: 6170).

In some embodiments, the fusion protein comprising a death receptor signal engager and a light chain of a first antigen binding domain targeting TRBC1 comprises an amino acid sequence of SEQ ID NO: 6171 (or an amino acid sequence having at least about 77%, 80%, 85%, 90%, 95%, or 99% sequence identity to SEQ ID NO: 6171).

In some embodiments, the fusion protein comprising a death receptor signal engager and a light chain of a first antigen binding domain targeting TRBC1 comprises an amino acid sequence of SEQ ID NO: 6172 (or an amino acid sequence having at least about 77%, 80%, 85%, 90%, 95%, or 99% sequence identity to SEQ ID NO: 6172).

In some embodiments, the multifunctional molecule comprises a fusion protein comprising a death receptor signal engager and a light chain of a first antigen binding domain targeting TRBC1 comprising an amino acid sequence of SEQ ID NO: 6170 (or an amino acid sequence having at least about 77%, 80%, 85%, 90%, 95%, or 99% sequence identity to SEQ ID NO: 6170), and a heavy chain of the first antigen binding domain targeting TRBC1 comprising an amino acid sequence of SEQ ID NO: 6167 (or an amino acid sequence having at least about 77%, 80%, 85%, 90%, 95%, or 99% sequence identity to SEQ ID NO: 6167). In some embodiments, the multifunctional molecule comprises a fusion protein comprising a death receptor signal engager and a light chain of a first antigen binding domain targeting TRBC1 comprising an amino acid sequence of SEQ ID NO: 6170 (or an amino acid sequence having at least about 77%, 80%, 85%, 90%, 95%, or 99% sequence identity to SEQ ID NO: 6170), and a heavy chain of the first antigen binding domain targeting TRBC1 comprising an amino acid sequence of SEQ ID NO: 6168 (or an amino acid sequence having at least about 77%, 80%, 85%, 90%, 95%, or 99% sequence identity to SEQ ID NO: 6168).

In some embodiments, the multifunctional molecule comprises a fusion protein comprising a death receptor signal engager and a light chain of a first antigen binding domain targeting TRBC1 comprising an amino acid sequence of SEQ ID NO: 6171 (or an amino acid sequence having at least about 77%, 80%, 85%, 90%, 95%, or 99% sequence identity to SEQ ID NO: 6171), and a heavy chain of the first antigen binding domain targeting TRBC1 comprising an amino acid sequence of SEQ ID NO: 6167 (or an amino acid sequence having at least about 77%, 80%, 85%, 90%, 95%, or 99% sequence identity to SEQ ID NO: 6167). In some embodiments, the multifunctional molecule comprises a fusion protein comprising a death receptor signal engager and a light chain of a first antigen binding domain targeting TRBC1 comprising an amino acid sequence of SEQ ID NO: 6171 (or an amino acid sequence having at least about 77%, 80%, 85%, 90%, 95%, or 99% sequence identity to SEQ ID NO: 6171), and a heavy chain of the first antigen binding domain targeting TRBC1 comprising an amino acid sequence of SEQ ID NO: 6168 (or an amino acid sequence having at least about 77%, 80%, 85%, 90%, 95%, or 99% sequence identity to SEQ ID NO: 6168).

In some embodiments, the multifunctional molecule comprises a fusion protein comprising a death receptor signal engager and a light chain of a first antigen binding domain targeting TRBC1 comprising an amino acid sequence of SEQ ID NO: 6172 (or an amino acid sequence having at least about 77%, 80%, 85%, 90%, 95%, or 99% sequence identity to SEQ ID NO: 6172), and a heavy chain of the first antigen binding domain targeting TRBC1 comprising an amino acid sequence of SEQ ID NO: 6167 (or an amino acid sequence having at least about 77%, 80%, 85%, 90%, 95%, or 99% sequence identity to SEQ ID NO: 6167). In some embodiments, the multifunctional molecule comprises a fusion protein comprising a death receptor signal engager and a light chain of a first antigen binding domain targeting TRBC1 comprising an amino acid sequence of SEQ ID NO: 6172 (or an amino acid sequence having at least about 77%, 80%, 85%, 90%, 95%, or 99% sequence identity to SEQ ID NO: 6172), and a heavy chain of the first antigen binding domain targeting TRBC1 comprising an amino acid sequence of SEQ ID NO: 6168 (or an amino acid sequence having at least about 77%, 80%, 85%, 90%, 95%, or 99% sequence identity to SEQ ID NO: 6168).

TABLE 28

Exemplary death receptor signal engagers

| SEQ ID NO | ID Ref. | Description | Sequence |
|---|---|---|---|
| SEQ ID NO: 6157 | monomeric_hTRAIL_aa122_281-hFc_Knob_Cys-Blank | Monomeric human TRAIL comprising residues 122-281 | METDTLLLWVLLLWVPGSTGDYKDDDDKGGGGSGTGGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGSGNGTSNGTSGSSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK |
| SEQ ID NO: 6158 | dimeric_hTRAIL_aa122_281-hFc_Knob_Cys-Blank | Dimeric human TRAIL comprising residues 122-281 | METDTLLLWVLLLWVPGSTGDYKDDDDKGGGGSGTGGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGSGNGTSNGTSGSSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK |

TABLE 28-continued

Exemplary death receptor signal engagers

| SEQ ID NO | ID Ref. | Description | Sequence |
|---|---|---|---|
| SEQ ID NO: 6159 | trimeric_hTRAIL_aa122_281-hFc_Knob_Cys-Blank | Trimeric human TRAIL comprising residues 122-281 | METDTLLLWVLLLWVPGSTGDYKDDDDKGGGGSGTGGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGSGNGTSNGTSGSSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK |
| SEQ ID NO: 6160 | monomeric hTRAIL_95-281-hFc_Knob_Cys-Blank | Monomeric human TRAIL comprising residues 95-281 | METDTLLLWVLLLWVPGSTGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK |
| SEQ ID NO: 6161 | dimeric_hTRAIL_95-281-hFc_Knob_Cys-Blank | Dimeric human TRAIL comprising residues 95-281 | METDTLLLWVLLLWVPGSTGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK |
| SEQ ID NO: 6162 | trimeric_hTRAIL_95-281-hFc_Knob_Cys-Blank | Trimeric human TRAIL comprising residues 95-281 | METDTLLLWVLLLWVPGSTGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSDKTHTCPPCPAPELLGGPSVFLFPPKPKDTLMISRTPEVTCVVVDVSHEDPEVKFNWYVDGVEVHNAKTKPREEQYNSTYRV |

TABLE 28-continued

Exemplary death receptor signal engagers

| SEQ ID NO | ID Ref. | Description | Sequence |
|---|---|---|---|
| | | | VSVLTVLHQDWLNGKEYKCKVSNKALPAPIEKTISK AKGQPREPQVYTLPPCREEMTKNQVSLWCLVKGFY PSDIAVEWESNGQPENNYKTTPPVLDSDGSFFLYSKL TVDKSRWQQGNVFSCSVMHEALHNHYTQKSLSLSP GK |
| SEQ ID NO: 6163 | a_hDR5_Tigatuzumab_scFv_VH_VL-hFc_Knob_Cys-Blank | Antigen binding domain specific to DR5, a.k.a. tigatuzumab | METDTLLLWVLLLWVPGSTGEVQLVESGGGLVQPG GSLRLSCAASGFTFSSYVMSWVRQAPGKGLEWVATI SSGGSYTYYPDSVKGRFTISRDNAKNTLYLQMNSLR AEDTAVYYCARRGDSMITTDYWGQGTLVTVSSGGG GSGGGGSGGGGSGGGGSDIQMTQSPSSLSASVGDRV TITCKASQDVGTAVAWYQQKPGKAPKLLIYWASTR HTGVPSRFSGSGSGTDFTLTISSLQPEDFATYYCQQY SSYRTFGQGTKVEIKGGGGSGGGGSDKTHTCPPCPA PELLGGPSVFLFPPKPKDTLMISRTPEVTCVVVDVSH EDPEVKFNWYVDGVEVHNAKTKPREEQYNSTYRVV SVLTVLHQDWLNGKEYKCKVSNKALPAPIEKTISKA KGQPREPQVYTLPPCREEMTKNQVSLWCLVKGFYPS DIAVEWESNGQPENNYKTTPPVLDSDGSFFLYSKLT VDKSRWQQGNVFSCSVMHEALHNHYTQKSLSLSPG K |
| SEQ ID NO: 6164 | a_hDR5_Drozitumab_scFv_VH_VL-hFc_Knob_Cys | Antigen binding domain specific to DR5, a.k.a. drozitumab | METDTLLLWVLLLWVPGSTGEVQLVQSGGGVERPG GSLRLSCAASGFTFDDYAMSWVRQAPGKGLEWVSG INWQGGSTGYADSVKGRVTISRDNAKNSLYLQMNS LRAEDTAVYYCAKILGAGRGWYFDYWGKGTTVTV SSGGGGSGGGGSGGGGSGGGGSSELTQDPAVSVAL GQTVRITCSGDSLRSYYASWYQQKPGQAPVLVIYGA NNRPSGIPDRFSGSSSGNTASLTITGAQAEDEADYYC NSADSSGNHVVFGGGTKLTVLGGGGSGGGGSDKTH TCPPCPAPELLGGPSVFLFPPKPKDTLMISRTPEVTCV VVDVSHEDPEVKFNWYVDGVEVHNAKTKPREEQY NSTYRVVSVLTVLHQDWLNGKEYKCKVSNKALPAP IEKTISKAKGQPREPQVYTLPPCREEMTKNQVSLWCL VKGFYPSDIAVEWESNGQPENNYKTTPPVLDSDGSF FLYSKLTVDKSRWQQGNVFSCSVMHEALHNHYTQK SLSLSPGK |
| SEQ ID NO: 6165 | a_hDR5_Conatumumab_scFv_VH_VL-hFc_Knob_Cys | Antigen binding domain specific to DR5, a.k.a. conatumumab | METDTLLLWVLLLWVPGSTGQVQLQESGPGLVKPS QTLSLTCTVSGGSISSGDYFWSWIRQLPGKGLEWIGH IHNSGTTYYNPSLKSRVTISVDTSKKQFSLRLSSVTAA DTAVYYCARDRGGDYYYGMDVWGQGTTVTVSSGG GGSGGGGSGGGGSGGGGSEIVLTQSPGTLSLSPGERA TLSCRASQGISRSYLAWYQQKPGQAPSLLIYGASSRA TGIPDRFSGSGSGTDFTLTISRLEPEDFAVYYCQQFGS SPWTFGQGTKVEIKRGGGGSGGGGSDKTHTCPPCPA PELLGGPSVFLFPPKPKDTLMISRTPEVTCVVVDVSH EDPEVKFNWYVDGVEVHNAKTKPREEQYNSTYRVV SVLTVLHQDWLNGKEYKCKVSNKALPAPIEKTISKA KGQPREPQVYTLPPCREEMTKNQVSLWCLVKGFYPS DIAVEWESNGQPENNYKTTPPVLDSDGSFFLYSKLT VDKSRWQQGNVFSCSVMHEALHNHYTQKSLSLSPG K |
| SEQ ID NO: 6170 | a_hTRBC1_Jovil_Hum 1_VL-hCLIg_vk-a_hDR5_Tigatuzumab_scFy_VH_VL | Antigen binding domain specific to DR5, a.k.a. tigatuzumab, with anti-TRBC1 light chain | METDTLLLWVLLLWVPGSTGDVVMTQSPLSLPVTP GEPASISCRSSQRLVHSNGNTYLHWYLQKPGQSPQL LIY*RVSNRFP*GVPDRFSGSGSGTDFTLKISRVEAEDVG VYFCS*QSTHVPYT*FGGGTKVEIKRTVAAPSVFIFPPSD EQLKSGTASVVCLLNNFYPREAKVQWKVDNALQSG NSQESVTEQDSKDSTYSLSSTLTLSKADYEKHKVYA CEVTHQGLSSPVTKSFNRGECGGGGSGGGGSGGGGS EVQLVESGGGLVQPGGSLRLSCAASGFTFSSYVMSW VRQAPGKGLEWVATISSGGSYTYYPDSVKGRFTISR DNAKNTLYLQMNSLRAEDTAVYYCARRGDSMITTD YWGQGTLVTVSSGGGGSGGGGSGGGGSGGGGSDIQ MTQSPSSLSASVGDRVTITCKASQDVGTAVAWYQQ KPGKAPKLLIYWASTRHTGVPSRFSGSGSGTDFTLTI SSLQPEDFATYYCQQYSSYRTFGQGTKVEIK |
| SEQ ID NO: 6171 | a_hTRBC1_Jovil_Hum 1_VL-hCLIg_vk-a_hDR5_Conatumumab ScFv_VH_ | Antigen binding domain specific to DR5, a.k.a. drozitumab, with anti- | METDTLLLWVLLLWVPGSTGDVVMTQSPLSLPVTP GEPASISCRSSQRLVHSNGNTYLHWYLQKPGQSPQL LIY*RVSNRFP*GVPDRFSGSGSGTDFTLKISRVEAEDVG VYFCS*QSTHVPYT*FGGGTKVEIKRTVAAPSVFIFPPSD EQLKSGTASVVCLLNNFYPREAKVQWKVDNALQSG NSQESVTEQDSKDSTYSLSSTLTLSKADYEKHKVYA CEVTHQGLSSPVTKSFNRGECGGGGSGGGGSGGGGS |

TABLE 28-continued

Exemplary death receptor signal engagers

| SEQ ID NO | ID Ref. | Description | Sequence |
|---|---|---|---|
| | VL | TRBC1 light chain | QVQLQESGPGLVKPSQTLSLTCTVSGGSISSGDYFWS WIRQLPGKGLEWIGHIHNSGTTYYNPSLKSRVTISVD TSKKQFSLRLSSVTAADTAVYYCARDRGGDYYYGM DVWGQGTTVTVSSGGGGSGGGGSGGGGSGGGGSEI VLTQSPGTLSLSPGERATLSCRASQGISRSYLAWYQQ KPGQAPSLLIYGASSRATGIPDRFSGSGSGTDFTLTIS RLEPEDFAVYYCQQFGSSPWTFGQGTKVEIKR |
| SEQ ID NO: 6172 | a_hTRBC1_ Jovil_Hum 1_VL- hCLlg_vk- a_hDR5_ Drozitumab_ scFv_VH_VL | Antigen binding domain specific to DR5, a.k.a. conatumumab, with anti-TRBC1 light chain | METDTLLLWVLLLWVPGSTGDVVMTQSPLSLPVTP GEPASISCRSSQRLVHSNGNTYLHWYLQKPGQSPQL LIY*RVSNRFP*GVPDRFSGSGSGTDFTLKISRVEAEDVG VYFCS*QSTHVPYT*FGGGTKVEIKRTVAAPSVFIFPPSD EQLKSGTASVVCLLNNFYPREAKVQWKVDNALQSG NSQESVTEQDSKDSTYSLSSTLTLSKADYEKHKVYA CEVTHQGLSSPVTKSFNRGECGGGGSGGGGSGGGGS EVQLVQSGGGVERPGGSLRLSCAASGFTFDDYAMS WVRQAPGKGLEWVSGINWQGGSTGYADSVKGRVTI SRDNAKNSLYLQMNSLRAEDTAVYYCAKILGAGRG WYFDYWGKGTTVTVSSGGGGSGGGGSGGGGSGGG GSSELTQDPAVSVALGQTVRITCSGDSLRSYYASWY QQKPGQAPVLVIYGANNRPSGIPDRFSGSSSGNTASL TITGAQAEDEADYYCNSADSSGNHVVFGGGTKLTVL |

T Cell Engagers

The present disclosure provides, inter alia, multispecific (e.g., bi-, tri-, quad-specific) or multifunctional molecules, that are engineered to contain one or more T cell engager that mediate binding to and/or activation of a T cell. Accordingly, in some embodiments, the T cell engager is selected from an antigen binding domain or ligand that binds to (e.g., and in some embodiments activates) one or more of CD3, TCRα, TCRβ, TCRγ, TCRζ, ICOS, CD28, CD27, HVEM, LIGHT, CD40, 4-4BB, OX40, DR3, GITR, CD30, TIM1, SLAM, CD2, or CD226. In other embodiments, the T cell engager is selected from an antigen binding domain or ligand that binds to and does not activate one or more of CD3, TCRα, TCRβ, TCRγ, TCRζ, ICOS, CD28, CD27, HVEM, LIGHT, CD40, 4-4BB, OX40, DR3, GITR, CD30, TIM1, SLAM, CD2, or CD226.

TCR Beta V Antigen Binding Domains

In some embodiments, the T cell engager is an antigen binding domain (e.g., an antibody molecule or fragment thereof) that binds to (e.g., and in some embodiments activates) TCRβ. This disclosure provides, inter alia, antibody molecules and fragments thereof, that bind, e.g., specifically bind, to a human TCR beta V chain (TCRBV), e.g., a TCRβV gene family, e.g., a TCRβV subfamily, e.g., as described herein. TCR beta V families and subfamilies are known in the art, e.g., as described in Yassai et al., (2009) *Immunogenetics* 61(7) pp: 493-502; Wei S. and Concannon P. (1994) *Human Immunology* 41(3) pp: 201-206. The antibodies described herein can be recombinant antibodies, e.g., recombinant non-murine antibodies, e.g., recombinant human or humanized antibodies. Throughout this disclosure, TCRβV and TCRBV are used interchangeably.

In some embodiments, the disclosure provides T cell engagers comprising an anti-TCRβV antibody molecule that binds to human TCRβV, e.g., a TCRβV family, e.g., gene family. In some embodiments a TCRBV gene family comprises one or more subfamilies, e.g., as described herein, e.g., in FIG. 6. In some embodiments, the TCRβV gene family comprises subfamilies comprising: a TCRβ V6 subfamily, a TCRβ V10 subfamily, a TCRβ V12 subfamily, a TCRβ V5 subfamily, a TCRβ V7 subfamily, a TCRβ V11 subfamily, a TCRβ V14 subfamily, a TCRβ V16 subfamily, a TCRβ V18 subfamily, a TCRβ V9 subfamily, a TCRβ V13 subfamily, a TCRβ V4 subfamily, a TCRβ V3 subfamily, a TCRβ V2 subfamily, a TCRβ V15 subfamily, a TCRβ V30 subfamily, a TCRβ V19 subfamily, a TCRβ V27 subfamily, a TCRβ V28 subfamily, a TCRβ V24 subfamily, a TCRβ V20 subfamily, TCRβ V25 subfamily, or a TCRβ V29 subfamily.

In some embodiments, TCRβ V6 subfamily is also known as TCRβ V13.1. In some embodiments, the TCRβ V6 subfamily comprises: TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01. In some embodiments, TCRβ V6 comprises TCRβ V6-5*01. In some embodiments, TCRβ V6, e.g., TCRβ V6-5*01, is recognized, e.g., bound, by SEQ ID NO: 1 and/or SEQ ID NO: 2. In some embodiments, TCRβ V6, e.g., TCRβ V6-5*01, is recognized, e.g., bound, by SEQ ID NO: 9 and/or SEQ ID NO: 10. In some embodiments, TCRβ V6 is recognized, e.g., bound, by SEQ ID NO: 9 and/or SEQ ID NO: 11.

In some embodiments, TCRβ V10 subfamily is also known as TCRβ V12. In some embodiments, the TCRβ V10 subfamily comprises: TCRβ V10-1*01, TCRβ V10-1*02, TCRβ V10-3*01 or TCRβ V10-2*01.

In some embodiments, TCRβ V12 subfamily is also known as TCRβ V8.1. In some embodiments, the TCRβ V12 subfamily comprises: TCRβ V12-4*01, TCRβ V12-3*01, or TCRβ V12-5*01. In some embodiments, TCRβ V12 is recognized, e.g., bound, by SEQ ID NO: 15 and/or SEQ ID NO: 16. In some embodiments, TCRβ V12 is recognized, e.g., bound, by any one of SEQ ID NOs 23-25, and/or any one of SEQ ID NO: 26-30:

In some embodiments, the TCRβ V5 subfamily is chosen from: TCRβ V5-5*01, TCRβ V5-6*01, TCRβ V5-4*01, TCRβ V5-8*01, TCRβ V5-1*01.

In some embodiments, the TCRβ V7 subfamily comprises TCRβ V7-7*01, TCRβ V7-6*01, TCRβ V7-8*02, TCRβ V7-4*01, TCRβ V7-2*02, TCRβ V7-2*03, TCRβ V7-2*01, TCRβ V7-3*01, TCRβ V7-9*03, or TCRβ V7-9*01.

In some embodiments, the TCRβ V11 subfamily comprises: TCRβ V11-1*01, TCRβ V11-2*01 or TCRβ V11-3*01.

In some embodiments, the TCRβ V14 subfamily comprises TCRβ V14*01.

In some embodiments, the TCRβ V16 subfamily comprises TCRβ V16*01.

In some embodiments, the TCRβ V24 subfamily comprises TCRβ V24-1*01.

In some embodiments, the TCRβ V20 subfamily comprises TCRβ V201*01, or TCRβ V20-102.

In some embodiments, the TCRβ V25 subfamily comprises TCRβ V25-1*01.

In some embodiments, the TCRβ V29 subfamily comprises TCRβ V29-1*01.

TABLE 29

List of TCRβV subfamilies and subfamily members

Figure 6:
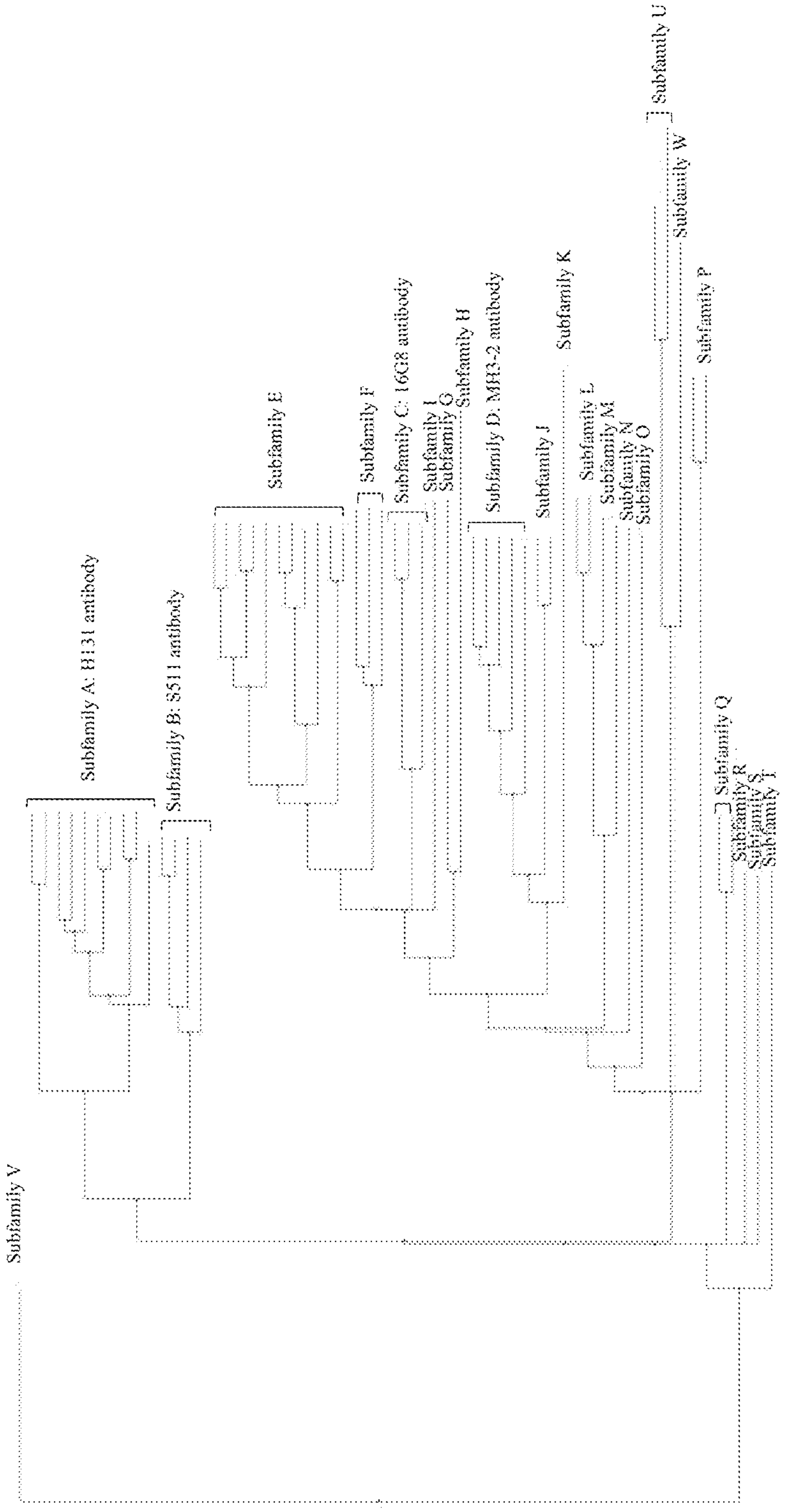
FIG. 6 depicts the phylogenetic tree of TCRBV gene family and subfamilies with corresponding antibodies mapped. Subfamily identities are as follows: Subfamily A: TCRβ V6; Subfamily B: TCRβ V10; Subfamily C: TCRβ V12; Subfamily D: TCRβ V5; Subfamily E: TCRβ V7; Subfamily F: TCRβ V11; Subfamily G: TCRβ V14; Subfamily H: TCRβ V16; Subfamily I: TCRβ V18; Subfamily J: TCRβ V9; Subfamily K: TCRβ V13; Subfamily L: TCRβ V4; Subfamily M: TCRβ V3; Subfamily N: TCRβ V2; Subfamily O: TCRβ V15; Subfamily P: TCRβ V30; Subfamily Q: TCRβ V19; Subfamily R: TCRβ V27; Subfamily S: TCRβ V28; Subfamily T: TCRβ V24; Subfamily U: TCRβ V20; Subfamily V: TCRβ V25; and Subfamily W: TCRβ V29 subfamily. Subfamily members are described in detail herein in the Section titled "TCR beta V (TCRβV)".

| Reference in FIG. 6 | Subfamily | Subfamily members |
|---|---|---|
| A | TCRβ V6 Also referred to as: TCR VB 13.1 | TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01. |
| B | TCRβ V10 Also referred to as: TCRβ V12 | TCRβ V10-1*01, TCRβ V10-1*02, TCRβ V10-3*01 or TCRβ V10-2*01 |
| C | TCRβ V12 Also referred to as: TCRβ V8.1 | TCRβ V12-4*01, TCRβ V12-3*01, or TCRβ V12-5*01 |
| D | TCRβ V5 | TCRβ V5-5*01, TCRβ V5-6*01, TCRβ V5-4*01, TCRβ V5-8*01, TCRβ V5-1*01 |
| E | TCRβ V7 | TCRβ V7-7*01, TCRβ V7-6*01, TCRβ V7 -8*02, TCRβ V7 -4*01, TCRβ V7-2*02, TCRβ V7-2*03, TCRβ V7-2*01, TCRβ V7-3*01, TCRβ V7-9*03, or TCRβ V7-9*01 |
| F | TCRβ V11 | TCRβ V11-1*01, TCRβ V11-2*01 or TCRβ V11-3*01 |
| G | TCRβ V14 | TCRβ V14*01 |
| H | TCRβ V16 | TCRβ V16*01 |
| I | TCRβ V18 | TCRβ V18*01 |
| J | TCRβ V9 | TCRβ V9*01 or TCRβ V9*02 |
| K | TCRβ V13 | TCRβ V13*01 |
| L | TCRβ V4 | TCRβ V4-2*01, TCRβ V4-3*01, or TCRβ V4-1*01 |
| M | TCRβ V3 | TCRβ V3-1*01 |
| N | TCRβ V2 | TCRβ V2*01 |
| O | TCRβ V15 | TCRβ V15*01 |
| P | TCRβ V30 | TCRβ V30*01, or TCRβ V30*02 |
| Q | TCRβ V19 | TCRβ V19*01, or TCRβ V19*02 |
| R | TCRβ V27 | TCRβ V27*01. |
| S | TCRβ V28 | TCRβ V28*01. |
| T | TCRβ V24 | TCRβ V24-1*01 |
| U | TCRβ V20 | TCRβ V20-1*01, or TCRβ V20-1*02 |
| V | TCRβ V25 | TCRβ V25-1*01 |
| W | TCRβ V29 | TCRβ V29-1*01 |

In some embodiments, the TCRβ V18 subfamily comprises TCRβ V18*01.

In some embodiments, the TCRβ V9 subfamily comprises TCRβ V9*01 or TCRβ V9*02.

In some embodiments, the TCRβ V13 subfamily comprises TCRβ V13*01.

In some embodiments, the TCRβ V4 subfamily comprises TCRβ V4-2*01, TCRβ V4-3*01, or TCRβ V4-1*01.

In some embodiments, the TCRβ V3 subfamily comprises TCRβ V3-1*01.

In some embodiments, the TCRβ V2 subfamily comprises TCRβ V2*01.

In some embodiments, the TCRβ V15 subfamily comprises TCRβ V15*01.

In some embodiments, the TCRβ V30 subfamily comprises TCRβ V30*01, or TCRβ V30*02.

In some embodiments, the TCRβ V19 subfamily comprises TCRβ V19*01, or TCRβ V19*02.

In some embodiments, the TCRβ V27 subfamily comprises TCRβ V27*01.

In some embodiments, the TCRβ V28 subfamily comprises TCRβ V28*01.

Anti-TCRβV Antibodies

In an aspect, the disclosure provides an anti-TCRβV antibody molecule that binds to human TCRβV, e.g., a TCRβV gene family, e.g., one or more of a TCRβV subfamily, e.g., as described herein, e.g., in FIG. 6. In some embodiments, the anti-TCRβV antibody molecule binds to one or more TCRβV subfamilies chosen from: a TCRβ V6 subfamily, a TCRβ V10 subfamily, a TCRβ V12 subfamily, a TCRβ V5 subfamily, a TCRβ V7 subfamily, a TCRβ V11 subfamily, a TCRβ V14 subfamily, a TCRβ V16 subfamily, a TCRβ V18 subfamily, a TCRβ V9 subfamily, a TCRβ V13 subfamily, a TCRβ V4 subfamily, a TCRβ V3 subfamily, a TCRβ V2 subfamily, a TCRβ V15 subfamily, a TCRβ V30 subfamily, a TCRβ V19 subfamily, a TCRβ V27 subfamily, a TCRβ V28 subfamily, a TCRβ V24 subfamily, a TCRβ V20 subfamily, TCRβ V25 subfamily, or a TCRβ V29 subfamily. In some embodiments, the anti-TCRβV antibody molecule binds to a TCRβ V6 subfamily comprising: TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01. In some embodiments the TCRβ V6 subfamily comprises TCRβ

V6-5*01. In some embodiments, the anti-TCRβV antibody molecule binds to a TCRβ V10 subfamily comprising: TCRβ V10-1*01, TCRβ V10-1*02, TCRβ V10-3*01 or TCRβ V10-2*01. In some embodiments, the anti-TCRβV antibody molecule binds to a TCRβ V12 subfamily comprising: TCRβ V12-4*01, TCRβ V12-3*01 or TCRβ V12-5*01. In some embodiments, the anti-TCRβV antibody molecule binds to a TCRβ V5 subfamily comprising: TCRβ V5-5*01, TCRβ V5-6*01, TCRβ V5-4*01, TCRβ V5-8*01, TCRβ V5-1*01.

In some embodiments, the anti-TCRβV antibody molecule does not bind to TCRβ V12, or binds to TCRβ V12 with an affinity and/or binding specificity that is less than (e.g., less than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments, the anti-TCRβV antibody molecule binds to TCRβ V12 with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments, the anti-TCRβV antibody molecule binds to a TCRβV region other than TCRβ V12 (e.g., TCRβV region as described herein, e.g., TCRβ V6 subfamily (e.g., TCRβ V6-5*01) with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments, the anti-TCRβV antibody molecule does not bind to TCRβ V5-5*01 or TCRβ V5-1*01, or binds to TCRβ V5-5*01 or TCRβ V5-1*01 with an affinity and/or binding specificity that is less than (e.g., less than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

In some embodiments, the anti-TCRβV antibody molecule binds to TCRβ V5-5*01 or TCRβ V5-1*01 with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

In some embodiments, the anti-TCRβV antibody molecule binds to a TCRβV region other than TCRβ V5-5*01 or TCRβ V5-1*01 (e.g., TCRβV region as described herein, e.g., TCRβ V6 subfamily (e.g., TCRβ V6-5*01) with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

Anti-TCRβV6 Antibodies

Accordingly, in one aspect, the disclosure provides an anti-TCRβV antibody molecule that binds to human TCRβ V6, e.g., a TCRβ V6 subfamily comprising: TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01. In some embodiments the TCRβ V6 subfamily comprises TCRβ V6-5*01.

In some embodiments, TCRβ V6-5*01 is encoded by the nucleic acid sequence of SEQ ID NO: 43, or a sequence having 85%, 90%, 95%, 99% or more identity thereof.

```
                                              SEQ ID NO: 43
ATGAGCATCGGCCTCCTGTGCTGTGCAGCCTTGTCTCTCCTGTGGGCAG

GTCCAGTGAATGCTGGTGTCACTCAGACCCCAAAATTCCAGGTCCTGAA

GACAGGACAGAGCATGACACTGCAGTGTGCCCAGGATATGAACCATGAA

TACATGTCCTGGTATCGACAAGACCCAGGCATGGGGCTGAGGCTGATTC

ATTACTCAGTTGGTGCTGGTATCACTGACCAAGGAGAAGTCCCCAATGG

CTACAATGTCTCCAGATCAACCACAGAGGATTTCCCGCTCAGGCTGCTG

TCGGCTGCTCCCTCCCAGACATCTGTGTACTTCTGTGCCAGCAGTTACT

C
```

In some embodiments, TCRβ V6-5*01 comprises the amino acid sequence of SEQ ID NO: 44, or an amino acid sequence having 85%, 90%, 95%, 99% or more identity thereof.

```
                                              SEQ ID NO: 44
MSIGLLCCAALSLLWAGPVNAGVTQTPKFQVLKTGQSMTLQCAQDMNHE

YMSWYRQDPGMGLRLIHYSVGAGITDQGEVPNGYNVSRSTTEDFPLRLL

SAAPSQTSVYFCASSY
```

In some embodiments, the anti-TCRβV antibody molecule, e.g., anti-TCRβ V6 (e.g., anti-TCRβ V6-5*01) antibody molecule, is a non-murine antibody molecule, e.g., a human or humanized antibody molecule. In some embodiments, the anti-TCRβV antibody molecule, e.g., anti-TCRβ V6 (e.g., anti-TCRβ V6-5*01) antibody molecule is a human antibody molecule. In some embodiments, the anti-TCRβV antibody molecule, e.g., anti-TCRβ V6 (e.g., anti-TCRβ V6-5*01) antibody molecule is a humanized antibody molecule.

In some embodiments, the anti-TCRβV antibody molecule, e.g., anti-TCRβ V6 (e.g., anti-TCRβ V6-5*01) antibody molecule, is isolated or recombinant.

In some embodiments, the anti-TCRβV antibody molecule, e.g., anti-TCRβ V6 (e.g., anti-TCRβ V6-5*01) antibody molecule, comprises at least one antigen-binding region, e.g., a variable region or an antigen-binding fragment thereof, from an antibody described herein, e.g., an antibody chosen from BHM1709 or BHM1710, or as described in Table 30, or encoded by the nucleotide sequence in Table 30, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V6 (e.g., anti-TCRβ V6-5*01) antibody molecule, comprises at least one, two, three or four variable regions from an antibody described herein, e.g., an antibody chosen from BHM1709 or BHM1710, or as described in Table 30, or encoded by the nucleotide sequence in Table 30, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V6 (e.g., anti-TCRβ V6-5*01) antibody molecule, comprises at least one or two heavy chain variable regions from an antibody described herein, e.g., an antibody chosen from BHM1709 or BHM1710, or as described in Table 30, or encoded by the nucleotide sequence in Table 30, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V6 (e.g., anti-TCRβ V6-5*01) antibody molecule, comprises at least one or two light chain variable regions from an antibody described herein, e.g., an antibody chosen from BHM1709 or BHM1710, or as described in Table 30, or encoded by the nucleotide sequence in Table 30, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V6 (e.g., anti-TCRβ V6-5*01) antibody molecule, comprises a heavy chain constant region for an IgG4, e.g., a human IgG4. In still another embodiment, the anti-TCRβV antibody molecule, e.g., anti-TCRβ V6 (e.g., anti-TCRβ V6-5*01) antibody molecule includes a heavy chain constant region for an IgG1, e.g., a human IgG1. In one embodiment, the heavy chain constant region comprises an amino sequence set forth in Table 32, or a sequence substantially identical (e.g., at least 80%, 85%, 90%, 92%, 95%, 97%, 98%, 99% or higher identical) thereto.

In some embodiments, the anti-TCRβV antibody molecule, e.g., anti-TCRβ V6 (e.g., anti-TCRβ V6-5*01) antibody molecule, includes a kappa light chain constant region, e.g., a human kappa light chain constant region. In one embodiment, the light chain constant region comprises an amino sequence set forth in Table 32, or a sequence substantially identical (e.g., at least 80%, 85%, 90%, 92%, 95%, 97%, 98%, 99% or higher identical) thereto.

In some embodiments, the anti-TCRβV antibody molecule, e.g., anti-TCRβ V6 (e.g., anti-TCRβ V6-5*01) antibody molecule, includes at least one, two, or three complementarity determining regions (CDRs) from a heavy chain variable region of an antibody described herein, e.g., an antibody chosen from BHM1709 or BHM1710, or as described in Table 30, or encoded by the nucleotide sequence in Table 30, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V6 (e.g., anti-TCRβ V6-5*01) antibody molecule, includes at least one, two, or three CDRs (or collectively all of the CDRs) from a heavy chain variable region comprising an amino acid sequence shown in Table 30, or encoded by a nucleotide sequence shown in Table 30. In one embodiment, one or more of the CDRs (or collectively all of the CDRs) have one, two, three, four, five, six or more changes, e.g., amino acid substitutions or deletions, relative to the amino acid sequence shown in Table 30, or encoded by a nucleotide sequence shown in Table 30.

In some embodiments, the anti-TCRβV antibody molecule, e.g., anti-TCRβ V6 (e.g., anti-TCRβ V6-5*01) antibody molecule, includes at least one, two, or three complementarity determining regions (CDRs) from a light chain variable region of an antibody described herein, e.g., an antibody chosen from BHM1709 or BHM1710, or as described in Table 30, or encoded by the nucleotide sequence in Table 30, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V6 (e.g., anti-TCRβ V6-5*01) antibody molecule, includes at least one, two, or three CDRs (or collectively all of the CDRs) from a light chain variable region comprising an amino acid sequence shown in Table 30, or encoded by a nucleotide sequence shown in Table 30. In one embodiment, one or more of the CDRs (or collectively all of the CDRs) have one, two, three, four, five, six or more changes, e.g., amino acid substitutions or deletions, relative to the amino acid sequence shown in Table 30, or encoded by a nucleotide sequence shown in Table 30.

In some embodiments, the anti-TCRβV antibody molecule, e.g., anti-TCRβ V6 (e.g., anti-TCRβ V6-5*01) antibody molecule, includes at least one, two, three, four, five or six CDRs (or collectively all of the CDRs) from a heavy and light chain variable region comprising an amino acid sequence shown in Table 30, or encoded by a nucleotide sequence shown in Table 30. In one embodiment, one or more of the CDRs (or collectively all of the CDRs) have one, two, three, four, five, six or more changes, e.g., amino acid substitutions or deletions, relative to the amino acid sequence shown in Table 30, or encoded by a nucleotide sequence shown in Table 30.

In some embodiments, the anti-TCRβV antibody molecule, e.g., anti-TCRβ V6 (e.g., anti-TCRβ V6-5*01) antibody molecule, molecule includes all six CDRs from an antibody described herein, e.g., an antibody chosen from BHM1709 or BHM1710, or as described in Table 30, or encoded by the nucleotide sequence in Table 30, or closely related CDRs, e.g., CDRs which are identical or which have at least one amino acid alteration, but not more than two, three or four alterations (e.g., substitutions, deletions, or insertions, e.g., conservative substitutions). In some embodiments, the anti-TCRβV antibody molecule, e.g., anti-TCRβ V6 (e.g., anti-TCRβ V6-5*01) antibody molecule, may include any CDR described herein.

In some embodiments, the anti-TCRβV antibody molecule, e.g., anti-TCRβ V6 (e.g., anti-TCRβ V6-5*01) antibody molecule includes at least one, two, or three CDRs according to Kabat et al. (e.g., at least one, two, or three CDRs according to the Kabat definition as set out in Table 30) from a heavy chain variable region of an antibody described herein, e.g., an antibody chosen from BHM1709 or BHM1710, or as described in Table 30, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Kabat et al. shown in Table 30.

In some embodiments, the anti-TCRβV antibody molecule, e.g., anti-TCRβ V6 (e.g., anti-TCRβ V6-5*01) antibody molecule includes at least one, two, or three CDRs according to Kabat et al. (e.g., at least one, two, or three CDRs according to the Kabat definition as set out in Table 30) from a light chain variable region of an antibody described herein, e.g., an antibody chosen from BHM1709 or BHM1710, or as described in Table 30, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Kabat et al. shown in Table 30.

In some embodiments, the anti-TCRβV antibody molecule, e.g., anti-TCRβ V6 (e.g., anti-TCRβ V6-5*01) antibody molecule, includes at least one, two, three, four, five, or six CDRs according to Kabat et al. (e.g., at least one, two, three, four, five, or six CDRs according to the Kabat definition as set out in Table 30) from the heavy and light chain variable regions of an antibody described herein, e.g., an antibody chosen from BHM1709 or BHM1710, or as described in Table 30, or encoded by the nucleotide sequence in Table 30; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, three, four, five, or six CDRs according to Kabat et al. shown in Table 30.

In some embodiments, the anti-TCRβV antibody molecule, e.g., anti-TCRβ V6 (e.g., anti-TCRβ V6-5*01) antibody molecule, includes all six CDRs according to Kabat et al. (e.g., all six CDRs according to the Kabat definition as set out in Table 30) from the heavy and light chain variable regions of an antibody described herein, e.g., an antibody chosen from BHM1709 or BHM1710, or as described in Table 30, or encoded by the nucleotide sequence in Table 30; or encoded by the nucleotide sequence in Table 30; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to all six CDRs according to Kabat et al. shown in Table 30. In one embodiment, the anti-TCRβV antibody molecule, e.g., anti-TCRβ V6 (e.g., anti-TCRβ V6-5*01) antibody molecule, may include any CDR described herein.

In some embodiments, the anti-TCRβV antibody molecule, e.g., anti-TCRβ V6 (e.g., anti-TCRβ V6-5*01) antibody molecule, includes at least one, two, or three hypervariable loops that have the same canonical structures as the corresponding hypervariable loop of an antibody described herein, e.g., an antibody chosen from chosen from BHM1709 or BHM1710 e.g., the same canonical structures as at least loop 1 and/or loop 2 of the heavy and/or light chain variable domains of an antibody described herein. See, e.g., Chothia et al., (1992) J. Mol. Biol. 227:799-817; Tomlinson et al., (1992) J. Mol. Biol. 227:776-798 for descriptions of hypervariable loop canonical structures. These structures can be determined by inspection of the tables described in these references.

In some embodiments, the anti-TCRβV antibody molecule, e.g., anti-TCRβ V6 (e.g., anti-TCRβ V6-5*01) antibody molecule includes at least one, two, or three CDRs according to Chothia et al. (e.g., at least one, two, or three CDRs according to the Chothia definition as set out in Table 30) from a heavy chain variable region of an antibody described herein, e.g., an antibody chosen from BHM1709 or BHM1710, or as described in Table 30, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Chothia et al. shown in Table 30.

In some embodiments, the anti-TCRβV antibody molecule, e.g., anti-TCRβ V6 (e.g., anti-TCRβ V6-5*01) antibody molecule includes at least one, two, or three CDRs according to Chothia et al. (e.g., at least one, two, or three CDRs according to the Chothia definition as set out in Table 30) from a light chain variable region of an antibody described herein, e.g., an antibody chosen from BHM1709 or BHM1710, or as described in Table 30, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Chothia et al. shown in Table 30.

In some embodiments, the anti-TCRβV antibody molecule, e.g., anti-TCRβ V6 (e.g., anti-TCRβ V6-5*01) antibody molecule, includes at least one, two, three, four, five, or six CDRs according to Chothia et al. (e.g., at least one, two, three, four, five, or six CDRs according to the Chothia definition as set out in Table 30) from the heavy and light chain variable regions of an antibody described herein, e.g., an antibody chosen from BHM1709 or BHM1710, or as described in Table 30, or encoded by the nucleotide sequence in Table 30; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, three, four, five, or six CDRs according to Chothia et al. shown in Table 30.

In some embodiments, the anti-TCRβV antibody molecule, e.g., anti-TCRβ V6 (e.g., anti-TCRβ V6-5*01) antibody molecule, includes all six CDRs according to Chothia et al. (e.g., all six CDRs according to the Chothia definition as set out in Table 30) from the heavy and light chain variable regions of an antibody described herein, e.g., an antibody chosen from BHM1709 or BHM1710, or as described in Table 30, or encoded by the nucleotide sequence in Table 30; or encoded by the nucleotide sequence in Table 30; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to all six CDRs according to Chothia et al. shown in Table 30. In one embodiment, the anti-TCRβV antibody molecule, e.g., anti-TCRβ V6 (e.g., anti-TCRβ V6-5*01) antibody molecule, may include any CDR described herein.

In some embodiments, the anti-TCRβV antibody molecule, e.g., anti-TCRβ V6 (e.g., anti-TCRβ V6-5*01) antibody molecule, molecule includes a combination of CDRs or hypervariable loops defined according to Kabat et al., Chothia et al., or as described in Table 30.

In some embodiments, the anti-TCRβV antibody molecule, e.g., anti-TCRβ V6 (e.g., anti-TCRβ V6-5*01) antibody molecule, can contain any combination of CDRs or hypervariable loops according to the Kabat and Chothia definitions.

In some embodiments, a combined CDR as set out in Table 30 is a CDR that comprises a Kabat CDR and a Chothia CDR.

In some embodiments, the anti-TCRβV antibody molecule, e.g., anti-TCRβ V6 (e.g., anti-TCRβ V6-5*01) antibody molecule, molecule includes a combination of CDRs or hypervariable loops identified as combined CDRs in Table 30. In some embodiments, the anti-TCRβV antibody molecule, e.g., anti-TCRβ V6 (e.g., anti-TCRβ V6-5*01) antibody molecule, can contain any combination of CDRs or hypervariable loops according the "combined" CDRs are described in Table 30.

In an embodiment, e.g., an embodiment comprising a variable region, a CDR (e.g., a combined CDR, Chothia CDR or Kabat CDR), or other sequence referred to herein, e.g., in Table 30, the antibody molecule is a monospecific antibody molecule, a bispecific antibody molecule, a bivalent antibody molecule, a biparatopic antibody molecule, or an antibody molecule that comprises an antigen binding fragment of an antibody, e.g., a half antibody or antigen binding fragment of a half antibody. In certain embodiments the antibody molecule comprise a multispecific molecule, e.g., a bispecific molecule, e.g., as described herein.

In an embodiment, the anti-TCRβV antibody molecule, e.g., anti-TCRβ V6 (e.g., anti-TCRβ V6-5*01) antibody molecule includes:

(i) one, two or all of a light chain complementarity determining region 1 (LC CDR1), a light chain complementarity determining region 2 (LC CDR2), and a light chain complementarity determining region 3 (LC CDR3) of SEQ ID NO: 2, SEQ ID NO: 10 or SEQ ID NO: 11, and/or (ii) one, two or all of a heavy chain complementarity determining region 1 (HC CDR1), heavy chain complementarity determining region 2 (HC CDR2), and a heavy chain complementarity determining region 3 (HC CDR3) of SEQ ID NO: 1 or SEQ ID NO: 9.

In some embodiments, the anti-TCRβV antibody molecule, e.g., anti-TCRβ V6 (e.g., anti-TCRβ V6-5*01) antibody molecule comprises a LC CDR1, LC CDR2, and LC CDR3 of SEQ ID NO: 2, and a HC CDR1, HC CDR2, and HC CDR3 of SEQ ID NO: 1.

In some embodiments the anti-TCRβV antibody molecule, e.g., anti-TCRβ V6 (e.g., anti-TCRβ V6-5*01) antibody molecule comprises a LC CDR1, LC CDR2, and LC CDR3 of SEQ ID NO: 10, and a HC CDR1, HC CDR2, and HC CDR3 of SEQ ID NO: 9.

In some embodiments, the anti-TCRβV antibody molecule, e.g., anti-TCRβ V6 (e.g., anti-TCRβ V6-5*01) antibody molecule comprises a LC CDR1, LC CDR2, and LC CDR3 of SEQ ID NO: 11, and a HC CDR1, HC CDR2, and HC CDR3 of SEQ ID NO: 9.

In an embodiment, the anti-TCRβV antibody molecule, e.g., anti-TCRβ V6 (e.g., anti-TCRβ V6-5*01) antibody molecule comprises:

(i) a LC CDR1 amino acid sequence of SEQ ID NO: 6, a LC CDR2 amino acid sequence of SEQ ID NO: 7, or a LC CDR3 amino acid sequence of SEQ ID NO: 8; and/or (ii) a HC CDR1 amino acid sequence of SEQ ID NO: 3, a HC CDR2 amino acid sequence of SEQ ID NO: 4, or a HC CDR3 amino acid sequence of SEQ ID NO: 5.

In some embodiments, the anti-TCRβV antibody molecule, e.g., anti-TCRβ V6 (e.g., anti-TCRβ V6-5*01) antibody molecule comprises:

(i) a light chain variable region (VL) comprising a LC CDR1 amino acid sequence of SEQ ID NO: 6, a LC CDR2 amino acid sequence of SEQ ID NO: 7, or a LC CDR3 amino acid sequence of SEQ ID NO: 8; and/or (ii) a heavy chain variable region (VH) comprising a HC CDR1 amino acid sequence of SEQ ID NO: 3, a HC CDR2 amino acid sequence of SEQ ID NO: 4, or a HC CDR3 amino acid sequence of SEQ ID NO: 5.

In an embodiment, the anti-TCRβV antibody molecule, e.g., anti-TCRβ V6 (e.g., anti-TCRβ V6-5*01) antibody molecule comprises:

(i) a LC CDR1 amino acid sequence of SEQ ID NO: 51, a LC CDR2 amino acid sequence of SEQ ID NO: 52, or a LC CDR3 amino acid sequence of SEQ ID NO: 53; and/or (ii) a HC CDR1 amino acid sequence of SEQ ID NO: 45, a HC CDR2 amino acid sequence of SEQ ID NO: 46, or a HC CDR3 amino acid sequence of SEQ ID NO: 47.

In some embodiments, the anti-TCRβV antibody molecule, e.g., anti-TCRβ V6 (e.g., anti-TCRβ V6-5*01) antibody molecule comprises:

(i) a light chain variable region (VL) comprising a LC CDR1 amino acid sequence of SEQ ID NO: 51, a LC CDR2 amino acid sequence of SEQ ID NO: 52, or a LC CDR3 amino acid sequence of SEQ ID NO: 53; and/or (ii) a heavy chain variable region (VH) comprising a HC CDR1 amino acid sequence of SEQ ID NO: 45, a HC CDR2 amino acid sequence of SEQ ID NO: 46, or a HC CDR3 amino acid sequence of SEQ ID NO: 47.

In an embodiment, the anti-TCRβV antibody molecule, e.g., anti-TCRβ V6 (e.g., anti-TCRβ V6-5*01) antibody molecule comprises:

(i) a LC CDR1 amino acid sequence of SEQ ID NO: 54, a LC CDR2 amino acid sequence of SEQ ID NO: 55, or a LC CDR3 amino acid sequence of SEQ ID NO: 56; and/or (ii) a HC CDR1 amino acid sequence of SEQ ID NO: 48, a HC CDR2 amino acid sequence of SEQ ID NO: 49, or a HC CDR3 amino acid sequence of SEQ ID NO: 50.

In some embodiments, the anti-TCRβV antibody molecule, e.g., anti-TCRβ V6 (e.g., anti-TCRβ V6-5*01) antibody molecule comprises:

(i) a light chain variable region (VL) comprising a LC CDR1 amino acid sequence of SEQ ID NO: 54, a LC CDR2 amino acid sequence of SEQ ID NO: 55, or a LC CDR3 amino acid sequence of SEQ ID NO: 56; and/or (ii) a heavy chain variable region (VH) comprising a HC CDR1 amino acid sequence of SEQ ID NO: 48, a HC CDR2 amino acid sequence of SEQ ID NO: 49, or a HC CDR3 amino acid sequence of SEQ ID NO: 50.

In one embodiment, the light or the heavy chain variable framework (e.g., the region encompassing at least FR1, FR2, FR3, and optionally FR4) of the anti-TCRβV antibody molecule, e.g., anti-TCRβ V6 (e.g., anti-TCRβ V6-5*01) antibody molecule can be chosen from: (a) a light or heavy chain variable framework including at least 80%, 85%, 87% 90%, 92%, 93%, 95%, 97%, 98%, or 100% of the amino acid residues from a human light or heavy chain variable framework, e.g., a light or heavy chain variable framework residue from a human mature antibody, a human germline sequence, or a human consensus sequence; (b) a light or heavy chain variable framework including from 20% to 80%, 40% to 60%, 60% to 90%, or 70% to 95% of the amino acid residues from a human light or heavy chain variable framework, e.g., a light or heavy chain variable framework residue from a human mature antibody, a human germline sequence, or a human consensus sequence; (c) a non-human framework (e.g., a rodent framework); or (d) a non-human framework that has been modified, e.g., to remove antigenic or cytotoxic determinants, e.g., deimmunized, or partially humanized. In one embodiment, the light or heavy chain variable framework region (particularly FR1, FR2 and/or FR3) includes a light or heavy chain variable framework sequence at least 70, 75, 80, 85, 87, 88, 90, 92, 94, 95, 96, 97, 98, 99% identical or identical to the frameworks of a VL or VH segment of a human germline gene.

In some embodiments, the anti-TCRβV antibody molecule, e.g., anti-TCRβ V6 (e.g., anti-TCRβ V6-5*01) antibody molecule, comprises a heavy chain variable domain having at least one, two, three, four, five, six, seven, ten, fifteen, twenty or more changes, e.g., amino acid substitutions or deletions, from an amino acid sequence of BHM1709 or BHM1710 .g., the amino acid sequence of the FR region in the entire variable region, e.g., shown in FIG. 4A, or in SEQ ID NO: 9.

Alternatively, or in combination with the heavy chain substitutions described herein, the anti-TCRβV antibody molecule, e.g., anti-TCRβ V6 (e.g., anti-TCRβ V6-5*01) antibody molecule, comprises a light chain variable domain having at least one, two, three, four, five, six, seven, ten, fifteen, twenty or more amino acid changes, e.g., amino acid substitutions or deletions, from an amino acid sequence of BHM1709 or BHM1710 .e.g., the amino acid sequence of the FR region in the entire variable region, e.g., shown in FIG. 4B, or in SEQ ID NO: 10 or SEQ ID NO: 11.

In some embodiments, the anti-TCRβV antibody molecule, e.g., anti-TCRβ V6 (e.g., anti-TCRβ V6-5*01) antibody molecule, includes one, two, three, or four heavy chain framework regions shown in FIG. 4A, or a sequence substantially identical thereto.

In some embodiments, the anti-TCRβV antibody molecule, e.g., anti-TCRβ V6 (e.g., anti-TCRβ V6-5*01) antibody molecule, includes one, two, three, or four light chain framework regions shown in FIG. 4B, or a sequence substantially identical thereto.

In some embodiments, the anti-TCRβV antibody molecule, e.g., anti-TCRβ V6 (e.g., anti-TCRβ V6-5*01) antibody molecule, comprises the light chain framework region 1 of BHM1709 or BHM1710, e.g., as shown in FIG. 4B.

In some embodiments, the anti-TCRβV antibody molecule, e.g., anti-TCRβ V6 (e.g., anti-TCRβ V6-5*01) antibody molecule, comprises the light chain framework region 2 of BHM1709 or BHM1710, e.g., as shown in FIG. 4B.

In some embodiments, the anti-TCRβV antibody molecule, e.g., anti-TCRβ V6 (e.g., anti-TCRβ V6-5*01) antibody molecule, comprises the light chain framework region 3 of BHM1709 or BHM1710, e.g., as shown in FIG. 4B.

In some embodiments, the anti-TCRβV antibody molecule, e.g., anti-TCRβ V6 (e.g., anti-TCRβ V6-5*01) antibody molecule, comprises the light chain framework region 4 of BHM1709 or BHM1710, e.g., as shown in FIG. 4B.

In some embodiments, the anti-TCRβV antibody molecule, e.g., anti-TCRβ V6 (e.g., anti-TCRβ V6-5*01) antibody molecule, comprises a light chain variable domain comprising a framework region, e.g., framework region 1 (FR1), comprising a change, e.g., a substitution (e.g., a conservative substitution) at position 10 according to Kabat numbering. In some embodiments, the FR1 comprises a Phenylalanine at position 10, e.g., a Serine to Phenylalanine substitution. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises a light chain variable domain comprising a framework region, e.g., framework region 2 (FR2), comprising a change, e.g., a substitution (e.g., a conservative substitution) at a position disclosed herein according to Kabat numbering. In some embodiments, FR2 comprises a Histidine at position 36, e.g., a substitution at position 36 according to Kabat numbering, e.g., a Tyrosine to Histidine substitution. In some embodiments, FR2 comprises an Alanine at position 46, e.g., a substitution at position 46 according to Kabat numbering, e.g., a Arginine to Alanine substitution. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises a light chain variable domain comprising a framework region, e.g., framework region 3 (FR3), comprising a change, e.g., a substitution (e.g., a conservative substitution) at a position disclosed herein according to Kabat numbering. In some embodiments, FR3 comprises a Phenylalanine at position 87, e.g., a substitution at position 87 according to Kabat numbering, e.g., a Tyrosine to Phenylalanine substitution. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises a light chain variable domain comprising: (a) a framework region 1 (FR1) comprising a Phenylalanine at position 10, e.g., a substitution at position 10 according to Kabat numbering, e.g., a Serine to Phenylalanine substitution; (b) a framework region 2 (FR2) comprising a Histidine at position 36, e.g., a substitution at position 36 according to Kabat numbering, e.g., a Tyrosine to Histidine substitution, and a Alanine at position 46, e.g., a substitution at position 46 according to Kabat numbering, e.g., a Arginine to Alanine substitution; and (c) a framework region 3 (FR3) comprising a Phenylalanine at position 87, e.g., a substitution at position 87 according to Kabat numbering, e.g., a Tyrosine to Phenylalanine substitution, e.g., as shown in the amino acid sequence of SEQ ID NO: 10. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises a light chain variable domain comprising: (a) a framework region 2 (FR2) comprising a Histidine at position 36, e.g., a substitution at position 36 according to Kabat numbering, e.g., a Tyrosine to Histidine substitution, and a Alanine at position 46, e.g., a substitution at position 46 according to Kabat numbering, e.g., a Arginine to Alanine substitution; and (b) a framework region 3 (FR3) comprising a Phenylalanine at position 87, e.g., a substitution at position 87 according to Kabat numbering, e.g., a Tyrosine to Phenylalanine substitution, e.g., as shown in the amino acid sequence of SEQ ID NO: 11. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises a light chain variable domain comprising: (a) a framework region 1 (FR1) comprising a change, e.g., a substitution (e.g., a conservative substitution) at one or more (e.g., all) positions disclosed herein according to Kabat numbering; (b) a framework region 2 (FR2) comprising a change, e.g., a substitution (e.g., a conservative substitution) at one or more (e.g., all) position disclosed herein according to Kabat numbering and (c) a framework region 3 (FR3) comprising a change, e.g., a substitution (e.g., a conservative substitution) at one or more (e.g., all) position disclosed herein according to Kabat numbering. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises the heavy chain framework region 1 of BHM1709 or BHM1710, e.g., as shown in FIG. 4A.

In some embodiments, the anti-TCRβV antibody molecule, e.g., anti-TCRβ V6 (e.g., anti-TCRβ V6-5*01) antibody molecule, comprises the heavy chain framework region 2 of BHM1709 or BHM1710, e.g., as shown in FIG. 4A In some embodiments, the anti-TCRβV antibody molecule, e.g., anti-TCRβ V6 (e.g., anti-TCRβ V6-5*01) antibody molecule, comprises the heavy chain framework region 3 of BHM1709 or BHM1710, e.g., as shown in FIG. 4A.

In some embodiments, the anti-TCRβV antibody molecule, e.g., anti-TCRβ V6 (e.g., anti-TCRβ V6-5*01) antibody molecule, comprises the heavy chain framework region 4 of BHM1709 or BHM1710, e.g., as shown in FIG. 4A.

In some embodiments, the anti-TCRβV antibody molecule, e.g., anti-TCRβ V6 (e.g., anti-TCRβ V6-5*01) antibody molecule, comprises a heavy chain variable domain comprising a framework region, e.g., framework region 3 (FR3), comprising a change, e.g., a substitution (e.g., a conservative substitution) at a position disclosed herein according to Kabat numbering. In some embodiments, FR3 comprises a Threonine at position 73, e.g., a substitution at position 73 according to Kabat numbering, e.g., a Glutamic Acid to Threonine substitution. In some embodiments, FR3 comprises a Glycine at position 94, e.g., a substitution at position 94 according to Kabat numbering, e.g., a Arginine to Glycine substitution. In some embodiments, the substitution is relative to a human germline heavy chain framework region sequence.

In some embodiments, the anti-TCRβV antibody molecule, e.g., anti-TCRβ V6 (e.g., anti-TCRβ V6-5*01) antibody molecule, comprises a heavy chain variable domain comprising a framework region 3 (FR3) comprising a Threonine at position 73, e.g., a substitution at position 73 according to Kabat numbering, e.g., a Glutamic Acid to Threonine substitution, and a Glycine at position 94, e.g., a substitution at position 94 according to Kabat numbering, e.g., a Arginine to Glycine substitution, e.g., as shown in the amino acid sequence of SEQ ID NO: 10.

In some embodiments, the anti-TCRβV antibody molecule, e.g., anti-TCRβ V6 (e.g., anti-TCRβ V6-5*01) antibody molecule, comprises the heavy chain framework regions 1-4 of BHM1709 or BHM1710, e.g., SEQ ID NO: 9, or as shown in FIGS. 4A and 4B.

In some embodiments, the anti-TCRβV antibody molecule, e.g., anti-TCRβ V6 (e.g., anti-TCRβ V6-5*01) antibody molecule, comprises the light chain framework regions 1-4 of BHM1709, e.g., SEQ ID NO: 10, or as shown in FIGS. 4A and 4B.

In some embodiments, the anti-TCRβV antibody molecule, e.g., anti-TCRβ V6 (e.g., anti-TCRβ V6-5*01) antibody molecule, comprises the light chain framework regions 1-4 of BHM1710, e.g., SEQ ID NO: 11, or as shown in FIGS. 4A and 4B.

In some embodiments, the anti-TCRβV antibody molecule, e.g., anti-TCRβ V6 (e.g., anti-TCRβ V6-5*01) antibody molecule, comprises the heavy chain framework regions 1-4 of BHM1709, e.g., SEQ ID NO: 9; and the light chain framework regions 1-4 of BHM1709, e.g., SEQ ID NO: 10, or as shown in FIGS. 4A and 4B.

In some embodiments, the anti-TCRβV antibody molecule, e.g., anti-TCRβ V6 (e.g., anti-TCRβ V6-5*01) antibody molecule, comprises the heavy chain framework regions 1-4 of BHM1710, e.g., SEQ ID NO: 9; and the light chain framework regions 1-4 of BHM1710, e.g., SEQ ID NO: 11, or as shown in FIGS. 4A and 4B.

In some embodiments, the heavy or light chain variable domain, or both, of the anti-TCRβV antibody molecule, e.g., anti-TCRβ V6 (e.g., anti-TCRβ V6-5*01) antibody molecule, includes an amino acid sequence, which is substantially identical to an amino acid disclosed herein, e.g., at least 80%, 85%, 90%, 92%, 95%, 97%, 98%, 99% or higher identical to a variable region of an antibody described herein, e.g., an antibody chosen from BHM1709 or BHM1710, or as described in Table 30, or encoded by the nucleotide sequence in Table 30; or which differs at least 1 or 5 residues, but less than 40, 30, 20, or 10 residues, from a variable region of an antibody described herein.

In some embodiments, the anti-TCRβV antibody molecule, e.g., anti-TCRβ V6 (e.g., anti-TCRβ V6-5*01) antibody molecule, comprises at least one, two, three, or four antigen-binding regions, e.g., variable regions, having an amino acid sequence as set forth in Table 30, or a sequence substantially identical thereto (e.g., a sequence at least about 85%, 90%, 95%, 99% or more identical thereto, or which differs by no more than 1, 2, 5, 10, or 15 amino acid residues from the sequences shown in Table 30. In another embodiment, the anti-TCRβV antibody molecule, e.g., anti-TCRβ V6 (e.g., anti-TCRβ V6-5*01) antibody molecule includes a VH and/or VL domain encoded by a nucleic acid having a nucleotide sequence as set forth in Table 30, or a sequence substantially identical thereto (e.g., a sequence at least about 85%, 90%, 95%, 99% or more identical thereto, or which differs by no more than 3, 6, 15, 30, or 45 nucleotides from the sequences shown in Table 30.

In some embodiments, the anti-TCRβV antibody molecule, e.g., anti-TCRβ V6 (e.g., anti-TCRβ V6-5*01) antibody molecule, comprises:

- a VH domain comprising the amino acid sequence of SEQ ID NO: 9, an amino acid sequence at least about 85%, 90%, 95%, 99% or more identical to the amino acid sequence of SEQ ID NO: 9, or an amino acid sequence which differs by no more than 1, 2, 5, 10, or 15 amino acid residues from the amino acid sequence of SEQ ID NO: 9; and/or
- a VL domain comprising the amino acid sequence of SEQ ID NO: 10, an amino acid sequence at least about 85%, 90%, 95%, 99% or more identical to the amino acid sequence of SEQ ID NO: 10, or an amino acid sequence which differs by no more than 1, 2, 5, 10, or 15 amino acid residues from the amino acid sequence of SEQ ID NO: 10.

In some embodiments, the anti-TCRβV antibody molecule, e.g., anti-TCRβ V6 (e.g., anti-TCRβ V6-5*01) antibody molecule, comprises:

- a VH domain comprising the amino acid sequence of SEQ ID NO: 9, an amino acid sequence at least about 85%, 90%, 95%, 99% or more identical to the amino acid sequence of SEQ ID NO: 9, or an amino acid sequence which differs by no more than 1, 2, 5, 10, or 15 amino acid residues from the amino acid sequence of SEQ ID NO: 9; and/or
- a VL domain comprising the amino acid sequence of SEQ ID NO: 11, an amino acid sequence at least about 85%, 90%, 95%, 99% or more identical to the amino acid sequence of SEQ ID NO: 11, or an amino acid sequence which differs by no more than 1, 2, 5, 10, or 15 amino acid residues from the amino acid sequence of SEQ ID NO: 11.

In some embodiments, the anti-TCRβV antibody molecule, e.g., anti-TCRβ V6 (e.g., anti-TCRβ V6-5*01) antibody molecule is a full antibody or fragment thereof (e.g., a Fab, $F(ab')_2$, Fv, or a single chain Fv fragment (scFv)). In embodiments, the anti-TCRβV antibody molecule, e.g., anti-TCRβ V6 (e.g., anti-TCRβ V6-5*01) antibody molecule is a monoclonal antibody or an antibody with single specificity. In some embodiments, the anti-TCRβV antibody molecule, e.g., anti-TCRβ V6 (e.g., anti-TCRβ V6-5*01) antibody molecule, can also be a humanized, chimeric, camelid, shark, or an in vitro-generated antibody molecule. In some embodiments, the anti-TCRβV antibody molecule, e.g., anti-TCRβ V6 (e.g., anti-TCRβ V6-5*01) antibody molecule, is a humanized antibody molecule. The heavy and light chains of the anti-TCRβV antibody molecule, e.g., anti-TCRβ V6 (e.g., anti-TCRβ V6-5*01) antibody molecule, can be full-length (e.g., an antibody can include at least one, and preferably two, complete heavy chains, and at least one, and preferably two, complete light chains) or can include an antigen-binding fragment (e.g., a Fab, F(ab')2, Fv, a single chain Fv fragment, a single domain antibody, a diabody (dAb), a bivalent antibody, or bispecific antibody or fragment thereof, a single domain variant thereof, or a camelid antibody).

In some embodiments, the anti-TCRβV antibody molecule, e.g., anti-TCRβ V6 (e.g., anti-TCRβ V6-5*01) antibody molecule, is in the form of a multispecific molecule, e.g., a bispecific molecule, e.g., as described herein.

In some embodiments, the anti-TCRβV antibody molecule, e.g., anti-TCRβ V6 (e.g., anti-TCRβ V6-5*01) antibody molecule, has a heavy chain constant region (Fc) chosen from, e.g., the heavy chain constant regions of IgG1, IgG2, IgG3, IgG4, IgM, IgA1, IgA2, IgD, and IgE. In some embodiments, the Fc region is chosen from the heavy chain constant regions of IgG1, IgG2, IgG3, and IgG4. In some embodiments, the Fc region is chosen from the heavy chain constant region of IgG1 or IgG2 (e.g., human IgG1, or IgG2). In some embodiments, the heavy chain constant region is human IgG1.

In some embodiments, the anti-TCRβV antibody molecule, e.g., anti-TCRβ V6 (e.g., anti-TCRβ V6-5*01) antibody molecule, has a light chain constant region chosen from, e.g., the light chain constant regions of kappa or lambda, preferably kappa (e.g., human kappa). In one embodiment, the constant region is altered, e.g., mutated, to modify the properties of the anti-TCRβV antibody molecule, e.g., anti-TCRβ V6 (e.g., anti-TCRβ V6-5*01) antibody molecule (e.g., to increase or decrease one or more of: Fc receptor binding, antibody glycosylation, the number of cysteine residues, effector cell function, or complement function). For example, the constant region is mutated at positions 296 (M to Y), 298 (S to T), 300 (T to E), 477 (H to K) and 478 (N to F) to alter Fc receptor binding (e.g., the mutated positions correspond to positions 132 (M to Y), 134 (S to T), 136 (T to E), 313 (H to K) and 314 (N to F) of SEQ ID NOs: 212 or 214; or positions 135 (M to Y), 137 (S to T), 139 (T to E), 316 (H to K) and 317 (N to F) of SEQ ID NOs: 215, 216, 217 or 218), e.g., relative to human IgG1.

TABLE 30

Amino acid and nucleotide sequences for murine, chimeric and humanized antibody molecules. The antibody molecules include murine mAb H131, and humanized mAb H131 Clones BHM1709 and BHM1710. The amino acid the heavy and light chain CDRs, and the amino acid and nucleotide sequences of the heavy and light chain variable regions, and the heavy and light chains are shown.

| | | | |
|---|---|---|---|
| **H131 (murine)** | | | |
| SEQ ID NO: 3 | HC CDR1 | (Combined) | GYSFTTYYIH |
| SEQ ID NO: 4 | HC CDR2 | (Combined) | WFFPGSGNIKYNEKFKG |
| SEQ ID NO: 5 | HC CDR3 | (Combined) | SYYSYDVLDY |
| SEQ ID NO: 45 | HC CDR1 | (Kabat) | TYYIH |
| SEQ ID NO: 46 | HC CDR2 | (Kabat) | WFFPGSGNIKYNEKFKG |
| SEQ ID NO: 47 | HC CDR3 | (Kabat) | SYYSYDVLDY |
| SEQ ID NO: 48 | HC CDR1 | (Chothia) | GYSFTTY |
| SEQ ID NO: 49 | HC CDR2 | (Chothia) | FPGSGN |
| SEQ ID NO: 50 | HC CDR3 | (Chothia) | SYYSYDVLDY |
| SEQ ID NO: 1 | VH | | QVQLQQSGPELVKPGTSVKISCKASGYSFTTYYIHW<br>VKQRPGQGLEWIGWFFPGSGNIKYNEKFKGKATLTA<br>DTSSSTAYMQLSSLTSEESAVYFCAGSYYSYDVLDY<br>WGHGTTLTVSS |
| SEQ ID NO: 6 | LC CDR1 | (Combined) | KASQNVGINVV |
| SEQ ID NO: 7 | LC CDR2 | (Combined)) | SSSHRYS |
| SEQ ID NO: 8 | LC CDR3 | (Combined) | QQFKSYPLT |
| SEQ ID NO: 51 | LC CDR1 | (Kabat) | KASQNVGINVV |
| SEQ ID NO: 52 | LC CDR2 | (Kabat) | SSSHRYS |
| SEQ ID NO: 53 | LC CDR3 | (Kabat) | QQFKSYPLT |
| SEQ ID NO: 54 | LC CDR1 | (Chothia) | KASQNVGINVV |
| SEQ ID NO: 55 | LC CDR2 | (chothia) | SSSHRYS |
| SEQ ID NO: 56 | LC CDR3 | (chothia) | QQFKSYPLT |
| SEQ ID NO: 2 | VL | | DILMTQSQKFMSTSLGDRVSVSCKASQNVGINVVW<br>HQQKPGQSPKALIYSSSHRYSGVPDRFTGSGSGTDFT<br>LTINNVQSEDLAEYFCQQFKSYPLTFGAGTKLELK |
| **BHM1709 (humanized)** | | | |
| SEQ ID NO: 3 | HC CDR1 | (Combined) | GYSFTTYYIH |
| SEQ ID NO: 4 | HC CDR2 | (Combined) | WFFPGSGNIKYNEKFKG |
| SEQ ID NO: 5 | HC CDR3 | (Combined) | SYYSYDVLDY |

TABLE 30-continued

Amino acid and nucleotide sequences for murine, chimeric and humanized antibody molecules. The antibody molecules include murine mAb H131, and humanized mAb H131 Clones BHM1709 and BHM1710. The amino acid the heavy and light chain CDRs, and the amino acid and nucleotide sequences of the heavy and light chain variable regions, and the heavy and light chains are shown.

| | | |
|---|---|---|
| SEQ ID NO: 9 | VH | QVQLVQSGAEVKKPGSSVKVSCKASGYSFTTYYIHW<br>VRQAPGQGLEWMGWFFPGSGNIKYNEKFKGRVTIT<br>ADTSTSTAYMELSSLRSEDTAVYYCAGSYYSYDVLD<br>YWGQGTTVTVSS |
| SEQ ID NO: 12 | DNA VH | CAGGTGCAGCTGGTTCAGTCTGGCGCCGAAGTGA<br>AGAAACCTGGCTCCTCCGTGAAGGTGTCCTGCAAG<br>GCTTCCGGCTACTCCTTCACCACCTACTACATCCA<br>CTGGGTCCGACAGGCCCCTGGACAAGGATTGGAA<br>TGGATGGGCTGGTTCTTCCCCGGCTCCGGCAACAT<br>CAAGTACAACGAGAAGTTCAAGGGCCGCGTGACC<br>ATCACCGCCGACACCTCTACCTCTACCGCCTACAT<br>GGAACTGTCCAGCCTGAGATCTGAGGACACCGCC<br>GTGTACTACTGCGCCGGCTCCTACTACTCTTACGA<br>CGTGCTGGATTACTGGGGCCAGGGCACCACAGTG<br>ACAGTGTCCTCT |
| SEQ ID NO: 6 | LC CDR1 (Combined) | KASQNVGINVV |
| SEQ ID NO: 7 | LC CDR2 (Combined)) | SSSHRYS |
| SEQ ID NO: 8 | LC CDR3 (Combined) | QQFKSYPLT |
| SEQ ID NO: 10 | VL | DIQMTQSPSFLSASVGDRVTITCKASQNVGINVVWH<br>QQKPGKAPKALIYSSSHRYSGVPSRFSGSGSGTEFTL<br>TISSLQPEDFATYFCQQFKSYPLTFGQGTKLEIK |
| SEQ ID NO: 13 | DNA VL | GACATCCAGATGACCCAGTCTCCATCCTTCCTGTC<br>CGCCTCTGTGGGCGACAGAGTGACCATCACATGCA<br>AGGCCTCTCAGAACGTGGGCATCAACGTCGTGTGG<br>CACCAGCAGAAGCCTGGCAAGGCTCCTAAGGCTC<br>TGATCTACTCCTCCAGCCACCGGTACTCTGGCGTG<br>CCCTCTAGATTTTCCGGCTCTGGCTCTGGCACCGA<br>GTTTACCCTGACAATCTCCAGCCTGCAGCCTGAGG<br>ACTTCGCCACCTACTTTTGCCAGCAGTTCAAGAGC<br>TACCCTCTGACCTTTGGCCAGGGCACCAAGCTGGA<br>AATCAAG |
| | BHM1710 (humanized) | |
| SEQ ID NO: 3 | HC CDR1 (Combined) | GYSFTTYYIH |
| SEQ ID NO: 4 | HC CDR2 (Combined) | WFFPGSGNIKYNEKFKG |
| SEQ ID NO: 5 | HC CDR3 (Combined) | SYYSYDVLDY |
| SEQ ID NO: 9 | VH | QVQLVQSGAEVKKPGSSVKVSCKASGYSFTTYYIHW<br>VRQAPGQGLEWMGWFFPGSGNIKYNEKFKGRVTIT<br>ADTSTSTAYMELSSLRSEDTAVYYCAGSYYSYDVLD<br>YWGQGTTVTVSS |
| SEQ ID NO: 12 | DNA VH | CAGGTGCAGCTGGTTCAGTCTGGCGCCGAAGTGA<br>AGAAACCTGGCTCCTCCGTGAAGGTGTCCTGCAAG<br>GCTTCCGGCTACTCCTTCACCACCTACTACATCCA<br>CTGGGTCCGACAGGCCCCTGGACAAGGATTGGAA<br>TGGATGGGCTGGTTCTTCCCCGGCTCCGGCAACAT<br>CAAGTACAACGAGAAGTTCAAGGGCCGCGTGACC<br>ATCACCGCCGACACCTCTACCTCTACCGCCTACAT<br>GGAACTGTCCAGCCTGAGATCTGAGGACACCGCC<br>GTGTACTACTGCGCCGGCTCCTACTACTCTTACGA<br>CGTGCTGGATTACTGGGGCCAGGGCACCACAGTG<br>ACAGTGTCCTCT |
| SEQ ID NO: 6 | LC CDR1 (Combined) | KASQNVGINVV |
| SEQ ID NO: 7 | LC CDR2 (Combined)) | SSSHRYS |
| SEQ ID NO: 8 | LC CDR3 (Combined) | QQFKSYPLT |
| SEQ ID NO: 11 | VL | DIQMTQSPSSLSASVGDRVTITCKASQNVGINVVWH<br>QQKPGKVPKALIYSSSHRYSGVPSRFSGSGSGTDFTL<br>TISSLQPEDVATYFCQQFKSYPLTFGQGTKLEIK |
| SEQ ID NO: 14 | DNA VL | GACATCCAGATGACCCAGTCTCCATCCTCTCTGTC<br>CGCCTCTGTGGGCGACAGAGTGACCATCACATGCA<br>AGGCCTCTCAGAACGTGGGCATCAACGTCGTGTGG<br>CACCAGCAGAAACCTGGCAAGGTGCCCAAGGCTC<br>TGATCTACTCCTCCAGCCACAGATACTCCGGCGTG<br>CCCTCTAGATTCTCCGGCTCTGGCTCTGGCACCGA<br>CTTTACCCTGACAATCTCCAGCCTGCAGCCTGAGG<br>ACGTGGCCACCTACTTTTGCCAGCAGTTCAAGAGC<br>TACCCTCTGACCTTTGGCCAGGGCACCAAGCTGGA<br>AATCAAG |

BHM1710 (humanized)

Anti-TCRβ V12 Antibodies

Accordingly, in one aspect, the disclosure provides an anti-TCRβV antibody molecule that binds to human TCRβ V12, e.g., a TCRβ V12 subfamily comprising: TCRβ V12-4*01, TCRβ V12-3*01 or TCRβ V12-5*01. In some embodiments the TCRβ V12 subfamily comprises TCRβ V12-4*01. In some embodiments the TCRβ V12 subfamily comprises TCRβ V12-3*01.

In some embodiments, the anti-TCRβV antibody molecule, e.g., anti-TCRβV12 antibody molecule, is a non-murine antibody molecule, e.g., a human or humanized antibody molecule. In some embodiments, the anti-TCRβV antibody molecule, e.g., anti-TCRβ V12 antibody molecule is a human antibody molecule. In some embodiments, the anti-TCRβV antibody molecule, e.g., anti-TCRβ V12 antibody molecule is a humanized antibody molecule.

In some embodiments, the anti-TCRβV antibody molecule, e.g., anti-TCRβ V12 antibody molecule, is isolated or recombinant.

In some embodiments, the anti-TCRβV antibody molecule, e.g., anti-TCRβ V12 antibody molecule, comprises at least one antigen-binding region, e.g., a variable region or an antigen-binding fragment thereof, from an antibody described herein, e.g., an antibody described in Table 31, or encoded by the nucleotide sequence in Table 31, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, comprises at least one, two, three or four variable regions from an antibody described herein, e.g., an antibody as described in Table 31, or encoded by the nucleotide sequence in Table 31, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, comprises at least one or two heavy chain variable regions from an antibody described herein, e.g., an antibody as described in Table 31, or encoded by the nucleotide sequence in Table 31, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, comprises at least one or two light chain variable regions from an antibody described herein, e.g., an antibody as described in Table 31, or encoded by the nucleotide sequence in Table 31, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, comprises a heavy chain constant region for an IgG4, e.g., a human IgG4. In still another embodiment, the anti-TCRβV antibody molecule, e.g., anti-TCRβ V12 antibody molecule, includes a heavy chain constant region for an IgG1, e.g., a human IgG1. In one embodiment, the heavy chain constant region comprises an amino sequence set forth in Table 32, or a sequence substantially identical (e.g., at least 80%, 85%, 90%, 92%, 95%, 97%, 98%, 99% or higher identical) thereto.

In some embodiments, the anti-TCRβV antibody molecule, e.g., anti-TCRβ V12 antibody molecule, includes a kappa light chain constant region, e.g., a human kappa light chain constant region. In one embodiment, the light chain constant region comprises an amino sequence set forth in Table 32, or a sequence substantially identical (e.g., at least 80%, 85%, 90%, 92%, 95%, 97%, 98%, 99% or higher identical) thereto.

In some embodiments, the anti-TCRβV antibody molecule, e.g., anti-TCRβ V12 antibody molecule, includes at least one, two, or three complementarity determining regions (CDRs) from a heavy chain variable region of an antibody described herein, e.g., an antibody as described in Table 31, or encoded by the nucleotide sequence in Table 31, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, includes at least one, two, or three CDRs (or collectively all of the CDRs) from a heavy chain variable region comprising an amino acid sequence shown in Table 31, or encoded by a nucleotide sequence shown in Table 31. In one embodiment, one or more of the CDRs (or collectively all of the CDRs) have one, two, three, four, five, six or more changes, e.g., amino acid substitutions or deletions, relative to the amino acid sequence shown in Table 31, or encoded by a nucleotide sequence shown in Table 31.

In some embodiments, the anti-TCRβV antibody molecule, e.g., anti-TCRβ V12 antibody molecule, includes at least one, two, or three complementarity determining regions (CDRs) from a light chain variable region of an antibody described herein, e.g., an antibody as described in Table 31, or encoded by the nucleotide sequence in Table 31, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, includes at least one, two, or three CDRs (or collectively all of the CDRs) from a light chain variable region comprising an amino acid sequence shown in Table 31, or encoded by a nucleotide sequence shown in Table 31. In one embodiment, one or more of the CDRs (or collectively all of the CDRs) have one, two, three, four, five, six or more changes, e.g., amino acid substitutions or deletions, relative to the amino acid sequence shown in Table 31, or encoded by a nucleotide sequence shown in Table 31.

In some embodiments, the anti-TCRβV antibody molecule, e.g., anti-TCRβ V12 antibody molecule, includes at least one, two, three, four, five or six CDRs (or collectively all of the CDRs) from a heavy and light chain variable region comprising an amino acid sequence shown in Table 31, or encoded by a nucleotide sequence shown in Table 31. In one embodiment, one or more of the CDRs (or collectively all of the CDRs) have one, two, three, four, five, six or more changes, e.g., amino acid substitutions or deletions, relative to the amino acid sequence shown in Table 31, or encoded by a nucleotide sequence shown in Table 31.

In some embodiments, the anti-TCRβV antibody molecule, e.g., anti-TCRβ V12 antibody molecule, molecule includes all six CDRs from an antibody described herein, e.g., an antibody as described in Table 31, or encoded by the nucleotide sequence in Table 31, or closely related CDRs, e.g., CDRs which are identical or which have at least one amino acid alteration, but not more than two, three or four alterations (e.g., substitutions, deletions, or insertions, e.g., conservative substitutions). In some embodiments, the anti-TCRβV antibody molecule, e.g., anti-TCRβ V12 antibody molecule, may include any CDR described herein.

In some embodiments, the anti-TCRβV antibody molecule, e.g., anti-TCRβ V12 antibody molecule includes at least one, two, or three CDRs according to Kabat et al. (e.g., at least one, two, or three CDRs according to the Kabat definition as set out in Table 31) from a heavy chain variable region of an antibody described herein, e.g., an antibody chosen as described in Table 31, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Kabat et al. shown in Table 31.

In some embodiments, the anti-TCRβV antibody molecule, e.g., anti-TCRβ V12 antibody molecule includes at least one, two, or three CDRs according to Kabat et al. (e.g., at least one, two, or three CDRs according to the Kabat definition as set out in Table 31) from a light chain variable region of an antibody described herein, e.g., an antibody as described in Table 31, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Kabat et al. shown in Table 31.

In some embodiments, the anti-TCRβV antibody molecule, e.g., anti-TCRβ V12 antibody molecule includes at least one, two, three, four, five, or six CDRs according to Kabat et al. (e.g., at least one, two, three, four, five, or six CDRs according to the Kabat definition as set out in Table 31) from the heavy and light chain variable regions of an antibody described herein, e.g., an antibody as described in Table 31, or encoded by the nucleotide sequence in Table 31; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, three, four, five, or six CDRs according to Kabat et al. shown in Table 31.

In some embodiments, the anti-TCRβV antibody molecule, e.g., anti-TCRβ V12 antibody molecule includes all six CDRs according to Kabat et al. (e.g., all six CDRs according to the Kabat definition as set out in Table 31) from the heavy and light chain variable regions of an antibody described herein, e.g., an antibody as described in Table 31, or encoded by the nucleotide sequence in Table 31; or encoded by the nucleotide sequence in Table 31; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to all six CDRs according to Kabat et al. shown in Table 31. In some embodiments, the anti-TCRβV antibody molecule, e.g., anti-TCRβ V12 antibody molecule may include any CDR described herein.

In some embodiments, the anti-TCRβV antibody molecule, e.g., anti-TCRβ V12 antibody molecule includes at least one, two, or three hypervariable loops that have the same canonical structures as the corresponding hypervariable loop of an antibody described herein, e.g., an antibody described in Table 31, e.g., the same canonical structures as at least loop 1 and/or loop 2 of the heavy and/or light chain variable domains of an antibody described herein. See, e.g., Chothia et al., (1992) J. Mol. Biol. 227:799-817; Tomlinson et al., (1992) J. Mol. Biol. 227:776-798 for descriptions of hypervariable loop canonical structures. These structures can be determined by inspection of the tables described in these references.

In some embodiments, the anti-TCRβV antibody molecule, e.g., anti-TCRβ V12 antibody molecule includes at least one, two, or three CDRs according to Chothia et al. (e.g., at least one, two, or three CDRs according to the Chothia definition as set out in Table 31) from a heavy chain variable region of an antibody described herein, e.g., an antibody chosen as described in Table 31, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Chothia et al. shown in Table 31.

In some embodiments, the anti-TCRβV antibody molecule, e.g., anti-TCRβ V12 antibody molecule includes at least one, two, or three CDRs according to Chothia et al. (e.g., at least one, two, or three CDRs according to the Chothia definition as set out in Table 31) from a light chain variable region of an antibody described herein, e.g., an antibody as described in Table 31, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Chothia et al. shown in Table 31.

In some embodiments, the anti-TCRβV antibody molecule, e.g., anti-TCRβ V12 antibody molecule includes at least one, two, three, four, five, or six CDRs according to Chothia et al. (e.g., at least one, two, three, four, five, or six CDRs according to the Chothia definition as set out in Table 31) from the heavy and light chain variable regions of an antibody described herein, e.g., an antibody as described in Table 31, or encoded by the nucleotide sequence in Table 31; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, three, four, five, or six CDRs according to Chothia et al. shown in Table 31.

In some embodiments, the anti-TCRβV antibody molecule, e.g., anti-TCRβ V12 antibody molecule includes all six CDRs according to Chothia et al. (e.g., all six CDRs according to the Chothia definition as set out in Table 31) from the heavy and light chain variable regions of an antibody described herein, e.g., an antibody as described in Table 31, or encoded by the nucleotide sequence in Table 31; or encoded by the nucleotide sequence in Table 31; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to all six CDRs according to Chothia et al. shown in Table 31. In some embodiments, the anti-TCRβV antibody molecule, e.g., anti-TCRβ V12 antibody molecule may include any CDR described herein.

In some embodiments, the anti-TCRβV antibody molecule, e.g., anti-TCRβ V12 antibody molecule includes at least one, two, or three CDRs according to a combined CDR (e.g., at least one, two, or three CDRs according to the combined CDR definition as set out in Table 31) from a heavy chain variable region of an antibody described herein, e.g., an antibody chosen as described in Table 31, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to combined CDR shown in Table 31.

In some embodiments, the anti-TCRβV antibody molecule, e.g., anti-TCRβ V12 antibody molecule includes at least one, two, or three CDRs according to a combined CDR (e.g., at least one, two, or three CDRs according to the combined CDR definition as set out in Table 31) from a light chain variable region of an antibody described herein, e.g., an antibody as described in Table 31, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to a combined CDR shown in Table 31.

In some embodiments, the anti-TCRβV antibody molecule, e.g., anti-TCRβ V12 antibody molecule includes at least one, two, three, four, five, or six CDRs according to a combined CDR. (e.g., at least one, two, three, four, five, or six CDRs according to the combined CDR definition as set out in Table 31) from the heavy and light chain variable regions of an antibody described herein, e.g., an antibody as described in Table 31, or encoded by the nucleotide sequence in Table 31; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, three, four, five, or six CDRs according to a combined CDR shown in Table 31.

In some embodiments, the anti-TCRβV antibody molecule, e.g., anti-TCRβ V12 antibody molecule includes all six CDRs according to a combined CDR (e.g., all six CDRs according to the combined CDR definition as set out in Table 31) from the heavy and light chain variable regions of an antibody described herein, e.g., an antibody as described in Table 31, or encoded by the nucleotide sequence in Table 31; or encoded by the nucleotide sequence in Table 31; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to all six CDRs according to a combined CDR shown in Table 31. In some embodiments, the anti-TCRβV antibody molecule, e.g., anti-TCRβ V12 antibody molecule may include any CDR described herein.

In some embodiments, a combined CDR as set out in Table 30 is a CDR that comprises a Kabat CDR and a Chothia CDR.

In some embodiments, the anti-TCRβV antibody molecule, e e.g., anti-TCRβ V12 antibody molecule, molecule includes a combination of CDRs or hypervariable loops identified as combined CDRs in Table 30. In some embodiments, the anti-TCRβV antibody molecule, e.g., anti-TCRβ V12 antibody molecule, can contain any combination of CDRs or hypervariable loops according the "combined" CDRs are described in Table 30.

In some embodiments, the anti-TCRβV antibody molecule, e.g., anti-TCRβ V12 antibody molecule includes a combination of CDRs or hypervariable loops defined according to the Kabat et al. and Chothia et al., or as described in Table 30

In some embodiments, the anti-TCRβV antibody molecule, e.g., anti-TCRβ V12 antibody molecule can contain any combination of CDRs or hypervariable loops according to the Kabat and Chothia definitions.

In an embodiment, e.g., an embodiment comprising a variable region, a CDR (e.g., a combined CDR, Chothia CDR or Kabat CDR), or other sequence referred to herein, e.g., in Table 31, the antibody molecule is a monospecific antibody molecule, a bispecific antibody molecule, a bivalent antibody molecule, a biparatopic antibody molecule, or an antibody molecule that comprises an antigen binding fragment of an antibody, e.g., a half antibody or antigen binding fragment of a half antibody. In certain embodiments the antibody molecule comprise a multispecific molecule, e.g., a bispecific molecule, e.g., as described herein.

In some embodiments, the anti-TCRβV antibody molecule, e.g., anti-TCRβ V12 antibody molecule includes:

(i) one, two or all of a light chain complementarity determining region 1 (LC CDR1), a light chain complementarity determining region 2 (LC CDR2), and a light chain complementarity determining region 3 (LC CDR3) of SEQ ID NO: 16, SEQ ID NO: 26, SEQ ID NO: 27, SEQ ID NO: 28, SEQ ID NO: 29 or SEQ ID NO: 30, and/or (ii) one, two or all of a heavy chain complementarity determining region 1 (HC CDR1), heavy chain complementarity determining region 2 (HC CDR2), and a heavy chain complementarity determining region 3 (HC CDR3) of SEQ ID NO: 15, SEQ ID NO: 23, SEQ ID NO: 24 or SEQ ID NO: 25.

In some embodiments, the anti-TCRβV antibody molecule, e.g., anti-TCRβ V12 antibody molecule comprises:

(i) a LC CDR1 amino acid sequence of SEQ ID NO: 20, a LC CDR2 amino acid sequence of SEQ ID NO: 21, or a LC CDR3 amino acid sequence of SEQ ID NO: 22; and/or (ii) a HC CDR1 amino acid sequence of SEQ ID NO: 17, a HC CDR2 amino acid sequence of SEQ ID NO: 18, or a HC CDR3 amino acid sequence of SEQ ID NO: 19.

In some embodiments, the anti-TCRβV antibody molecule, e.g., anti-TCRβ V12 antibody molecule comprises:

(i) a light chain variable region (VL) comprising a LC CDR1 amino acid sequence of SEQ ID NO: 20, a LC CDR2 amino acid sequence of SEQ ID NO: 21, and a LC CDR3 amino acid sequence of SEQ ID NO: 2; and/or (ii) a heavy chain variable region (VH) comprising a HC CDR1 amino acid sequence of SEQ ID NO: 17, a HC CDR2 amino acid sequence of SEQ ID NO: 18, and a HC CDR3 amino acid sequence of SEQ ID NO: 19.

In some embodiments, the anti-TCRβV antibody molecule, e.g., anti-TCRβ V12 antibody molecule comprises:

(i) a LC CDR1 amino acid sequence of SEQ ID NO: 63, a LC CDR2 amino acid sequence of SEQ ID NO: 64, or a LC CDR3 amino acid sequence of SEQ ID NO: 65; and/or (ii) a HC CDR1 amino acid sequence of SEQ ID NO: 57, a HC CDR2 amino acid sequence of SEQ ID NO: 58, or a HC CDR3 amino acid sequence of SEQ ID NO: 59.

In some embodiments, the anti-TCRβV antibody molecule, e.g., anti-TCRβ V12 antibody molecule comprises:

(i) a light chain variable region (VL) comprising a LC CDR1 amino acid sequence of SEQ ID NO: 63, a LC CDR2 amino acid sequence of SEQ ID NO: 64, or a LC CDR3 amino acid sequence of SEQ ID NO: 65; and/or (ii) a heavy chain variable region (VH) comprising a HC CDR1 amino acid sequence of SEQ ID NO: 57, a HC CDR2 amino acid sequence of SEQ ID NO: 58, or a HC CDR3 amino acid sequence of SEQ ID NO: 59.

In some embodiments, the anti-TCRβV antibody molecule, e.g., anti-TCRβ V12 antibody molecule comprises:

(i) a LC CDR1 amino acid sequence of SEQ ID NO: 66, a LC CDR2 amino acid sequence of SEQ ID NO: 67, or a LC CDR3 amino acid sequence of SEQ ID NO: 68; and/or (ii) a HC CDR1 amino acid sequence of SEQ ID NO: 60, a HC CDR2 amino acid sequence of SEQ ID NO: 61, or a HC CDR3 amino acid sequence of SEQ ID NO: 62.

In some embodiments, the anti-TCRβV antibody molecule, e.g., anti-TCRβ V12 antibody molecule comprises:

(i) a light chain variable region (VL) comprising a LC CDR1 amino acid sequence of SEQ ID NO: 63, a LC CDR2 amino acid sequence of SEQ ID NO: 64, or a LC CDR3 amino acid sequence of SEQ ID NO: 65; and/or (ii) a heavy chain variable region (VH) comprising a HC CDR1 amino acid sequence of SEQ ID NO: 57, a HC CDR2 amino acid sequence of SEQ ID NO: 58, or a HC CDR3 amino acid sequence of SEQ ID NO: 59.

In one embodiment, the light or the heavy chain variable framework (e.g., the region encompassing at least FR1, FR2, FR3, and optionally FR4) of the anti-TCRβV antibody molecule, e.g., anti-TCRβ V12 antibody molecule can be chosen from: (a) a light or heavy chain variable framework including at least 80%, 85%, 87% 90%, 92%, 93%, 95%, 97%, 98%, or 100% of the amino acid residues from a human light or heavy chain variable framework, e.g., a light or heavy chain variable framework residue from a human mature antibody, a human germline sequence, or a human consensus sequence; (b) a light or heavy chain variable framework including from 20% to 80%, 40% to 60%, 60% to 90%, or 70% to 95% of the amino acid residues from a human light or heavy chain variable framework, e.g., a light or heavy chain variable framework residue from a human mature antibody, a human germline sequence, or a human consensus sequence; (c) a non-human framework (e.g., a rodent framework); or (d) a non-human framework that has been modified, e.g., to remove antigenic or cytotoxic determinants, e.g., deimmunized, or partially humanized. In one embodiment, the light or heavy chain variable framework region (particularly FR1, FR2 and/or FR3) includes a light or heavy chain variable framework sequence at least 70, 75, 80, 85, 87, 88, 90, 92, 94, 95, 96, 97, 98, 99% identical or identical to the frameworks of a VL or VH segment of a human germline gene.

In some embodiments, the anti-TCRβV antibody molecule, e.g., anti-TCRβ V12 antibody molecule, comprises a heavy chain variable domain having at least one, two, three, four, five, six, seven, ten, fifteen, twenty or more changes, e.g., amino acid substitutions or deletions, from an amino acid sequence described in Table 31. e.g., the amino acid sequence of the FR region in the entire variable region, e.g., shown in FIGS. 5A and 5B, or in SEQ ID NOs: 23-25.

Alternatively, or in combination with the heavy chain substitutions described herein the anti-TCRβV antibody molecule, e.g., anti-TCRβ V12 antibody molecule comprises a light chain variable domain having at least one, two, three, four, five, six, seven, ten, fifteen, twenty or more amino acid changes, e.g., amino acid substitutions or deletions, from an amino acid sequence of an antibody described herein. e.g., the amino acid sequence of the FR region in the entire variable region, e.g., shown in FIGS. 5A and 5B, or in SEQ ID NOs: 26-30.

In some embodiments, the anti-TCRβV antibody molecule, e.g., anti-TCRβ V12 antibody molecule includes one, two, three, or four heavy chain framework regions shown in FIG. 5A, or a sequence substantially identical thereto.

In some embodiments, the anti-TCRβV antibody molecule, e.g., anti-TCRβ V12 antibody molecule includes one, two, three, or four light chain framework regions shown in FIG. 5B, or a sequence substantially identical thereto.

In some embodiments, the anti-TCRβV antibody molecule, e.g., anti-TCRβ V12 antibody molecule comprises the light chain framework region 1 e.g., as shown in FIG. 5B.

In some embodiments, the anti-TCRβV antibody molecule, e.g., anti-TCRβ V12 antibody molecule comprises the light chain framework region 2 e.g., as shown in FIG. 5B.

In some embodiments, the anti-TCRβV antibody molecule, e.g., anti-TCRβ V12 antibody molecule comprises the light chain framework region 3, e.g., as shown in FIG. 5B.

In some embodiments, the anti-TCRβV antibody molecule, e.g., anti-TCRβ V12 antibody molecule comprises the light chain framework region 4, e.g., as shown in FIG. 5B.

In some embodiments, the anti-TCRβV antibody molecule, e.g., anti-TCRβ V12 antibody molecule comprises a light chain comprising a framework region, e.g., framework region 1 (FR1), comprising a change, e.g., a substitution (e.g., a conservative substitution) at one or more, e.g., all, position disclosed herein according to Kabat numbering. In some embodiments, FR1 comprises an Aspartic Acid at position 1, e.g., a substitution at position 1 according to Kabat numbering, e.g., an Alanine to Aspartic Acid substitution. In some embodiments, FR1 comprises an Asparagine at position 2, e.g., a substitution at position 2 according to Kabat numbering, e.g., an Isoleucine to Asparagine substitution, Serine to Asparagine substitution or Tyrosine to Asparagine substitution. In some embodiments, FR1 comprises a Leucine at position 4, e.g., a substitution at position 4 according to Kabat numbering, e.g., a Methionine to Leucine substitution.

In some embodiments, the anti-TCRβV antibody molecule, e.g., anti-TCRβ V12 antibody molecule comprises a light chain comprising a framework region, e.g., framework region 1 (FR1), comprising a substitution at position 1 according to Kabat numbering, e.g., an Alanine to Aspartic Acid substitution, a substitution at position 2 according to Kabat numbering, e.g., an Isoleucine to Asparagine substitution, Serine to Asparagine substitution or Tyrosine to Asparagine substitution, and a substitution at position 4 according to Kabat numbering, e.g., a Methionine to Leucine substitution. In some embodiments, the anti-TCRβV antibody molecule, e.g., anti-TCRβ V12 antibody molecule comprises a light chain comprising a framework region, e.g., framework region 1 (FR1), comprising a substitution at position 1 according to Kabat numbering, e.g., an Alanine to Aspartic Acid substitution, and a substitution at position 2 according to Kabat numbering, e.g., an Isoleucine to Asparagine substitution, Serine to Asparagine substitution or Tyrosine to Asparagine substitution. In some embodiments, the anti-TCRβV antibody molecule, e.g., anti-TCRβ V12 antibody molecule comprises a light chain comprising a framework region, e.g., framework region 1 (FR1), comprising a substitution at position 1 according to Kabat numbering, e.g., an Alanine to Aspartic Acid substitution, and a substitution at position 4 according to Kabat numbering, e.g., a Methionine to Leucine substitution. In some embodiments, the anti-TCRβV antibody molecule, e.g., anti-TCRβ V12 antibody molecule comprises a light chain comprising a framework region, e.g., framework region 1 (FR1), comprising a substitution at position 2 according to Kabat numbering, e.g., an Isoleucine to Asparagine substitution, Serine to Asparagine substitution or Tyrosine to Asparagine substitution, and a substitution at position 4 according to Kabat numbering, e.g., a Methionine to Leucine substitution. In some embodiments, the substitution is relative to a human germline light chain framework region sequence.

In some embodiments, the anti-TCRβV antibody molecule, e.g., anti-TCRβ V12 antibody molecule comprises a light chain comprising a framework region, e.g., framework region 3 (FR3), comprising a change, e.g., a substitution (e.g., a conservative substitution) at one or more, e.g., all, position disclosed herein according to Kabat numbering. In some embodiments, FR3 comprises a Glycine at position 66, e.g., a substitution at position 66 according to Kabat numbering, e.g., a Lysine to Glycine substitution, or a Serine to Glycine substitution. In some embodiments, FR3 comprises an Asparagine at position 69, e.g., a substitution at position 69 according to Kabat numbering, e.g., a Tyrosine to Asparagine substitution. In some embodiments, FR3 comprises a Tyrosine at position 71, e.g., a substitution at position 71 according to Kabat numbering, e.g., a Phenylalanine to Tyrosine substitution, or an Alanine to Tyrosine substitution.

In some embodiments, the anti-TCRβV antibody molecule, e.g., anti-TCRβ V12 antibody molecule comprises a light chain comprising a framework region, e.g., framework region 3 (FR3), comprising a substitution at position 66 according to Kabat numbering, e.g., a Lysine to Glycine substitution, or a Serine to Glycine substitution, and a substitution at position 69 according to Kabat numbering, e.g., a Tyrosine to Asparagine substitution. In some embodiments, the anti-TCRβV antibody molecule, e.g., anti-TCRβ V12 antibody molecule comprises a light chain comprising a framework region, e.g., framework region 3 (FR3), comprising a substitution at position 66 according to Kabat numbering, e.g., Lysine to Glycine substitution, or a Serine to Glycine substitution, and a substitution at position 71 according to Kabat numbering, e.g., a Phenylalanine to Tyrosine substitution, or an Alanine to Tyrosine substitution. In some embodiments, the anti-TCRβV antibody molecule, e.g., anti-TCRβ V12 antibody molecule comprises a light chain comprising a framework region, e.g., framework region 3 (FR3), comprising a substitution at position 69 according to Kabat numbering, e.g., a Tyrosine to Asparagine substitution and a substitution at position 71 according to Kabat numbering, e.g., a Phenylalanine to Tyrosine substitution, or an Alanine to Tyrosine substitution. In some embodiments, the anti-TCRβV antibody molecule, e.g., anti-TCRβ V12 antibody molecule comprises a light chain comprising a framework region, e.g., framework region 3 (FR3), comprising a substitution at position 66 according to Kabat numbering, e.g., a Lysine to Glycine substitution, or a Serine to Glycine substitution, a substitution at position 69 according to Kabat numbering, e.g., a Tyrosine to Asparagine substitution and a substitution at position 71 according to Kabat numbering, e.g., a Phenylalanine to Tyrosine substitution, or an Alanine to Tyrosine substitution. In some embodiments, the substitution is relative to a human germline light chain framework region sequence.

In some embodiments, the anti-TCRβV antibody molecule, e.g., anti-TCRβ V12 antibody molecule comprises a light chain comprising: a framework region 1 (FR1) comprising a substitution at position 2 according to Kabat numbering, e.g., a Isoleucine to Asparagine substitution; and a framework region 3 (FR3), comprising a substitution at position 69 according to Kabat numbering, e.g., a Threonine to Asparagine substitution and a substitution at position 71 according to Kabat numbering, e.g., a Phenylalanine to Tyrosine substitution, e.g., as shown in the amino acid sequence of SEQ ID NO: 26. In some embodiments, the substitution is relative to a human germline light chain framework region sequence.

In some embodiments, the anti-TCRβV antibody molecule, e.g., anti-TCRβ V12 antibody molecule comprises a light chain comprising: (a) a framework region 1 (FR1) comprising a substitution at position 1 according to Kabat numbering, e.g., a Alanine to Aspartic Acid substitution, and a substitution at position 2 according to Kabat numbering, e.g., a Isoleucine to Asparagine substitution; and (b) a framework region 3 (FR3), comprising a substitution at position 69 according to Kabat numbering, e.g., a Threonine to Asparagine substitution and a substitution at position 71 according to Kabat numbering, e.g., a Phenylalanine to Tyrosine substitution, e.g., as shown in the amino acid sequence of SEQ ID NO: 27 In some embodiments, the substitution is relative to a human germline light chain framework region sequence.

In some embodiments, the anti-TCRβV antibody molecule, e.g., anti-TCRβ V12 antibody molecule comprises a light chain comprising: (a) a framework region 1 (FR1) comprising a substitution at position 2 according to Kabat numbering, e.g., a Serine to Asparagine substitution; and a substitution at position 4 according to Kabat numbering, e.g., a Methionine to Leucine substitution; and (b) a framework region 3 (FR3), comprising a substitution at position 69 according to Kabat numbering, e.g., a Threonine to Asparagine substitution and a substitution at position 71 according to Kabat numbering, e.g., a Phenylalanine to Tyrosine substitution, e.g., as shown in the amino acid sequence of SEQ ID NO: 28 In some embodiments, the substitution is relative to a human germline light chain framework region sequence.

In some embodiments, the anti-TCRβV antibody molecule, e.g., anti-TCRβ V12 antibody molecule comprises a light chain comprising: (a) a framework region 1 (FR1) comprising a substitution at position 2 according to Kabat numbering, e.g., a Serine to Asparagine substitution; and (b) a framework region 3 (FR3) comprising a substitution at position 66 according to Kabat numbering, e.g., a Lysine to Glycine substitution; a substitution at position 69 according to Kabat numbering, e.g., a Threonine to Asparagine substitution; and a substitution at position 71 according to Kabat numbering, e.g., a Alanine to Tyrosine substitution, e.g., as shown in the amino acid sequence of SEQ ID NO: 29. In some embodiments, the substitution is relative to a human germline light chain framework region sequence.

In some embodiments, the anti-TCRβV antibody molecule, e.g., anti-TCRβ V12 antibody molecule comprises a light chain comprising: (a) a framework region 1 (FR1) comprising a substitution at position 2 according to Kabat numbering, e.g., a Tyrosine to Asparagine substitution; and (b) a framework region 3 (FR3) comprising a substitution at position 66 according to Kabat numbering, e.g., a Serine to Glycine substitution; a substitution at position 69 according to Kabat numbering, e.g., a Threonine to Asparagine substitution; and a substitution at position 71 according to Kabat numbering, e.g., a Alanine to Tyrosine substitution, e.g., as shown in the amino acid sequence of SEQ ID NO: 29. In some embodiments, the substitution is relative to a human germline light chain framework region sequence.

In some embodiments, the anti-TCRβV antibody molecule, e.g., anti-TCRβ V12 antibody molecule comprises a light chain variable domain comprising: (a) a framework region 1 (FR1) comprising a change, e.g., a substitution (e.g., a conservative substitution) at one or more (e.g., all) positions disclosed herein according to Kabat numbering, and (b) a framework region 3 (FR3) comprising a change, e.g., a substitution (e.g., a conservative substitution) at one or more (e.g., all) position disclosed herein according to Kabat numbering. In some embodiments, the substitution is relative to a human germline light chain framework region sequence.

In some embodiments, the anti-TCRβV antibody molecule, e.g., anti-TCRβ V12 antibody molecule comprises the heavy chain framework region 1, e.g., as shown in FIG. 5A.

In some embodiments, the anti-TCRβV antibody molecule, e.g., anti-TCRβ V12 antibody molecule comprises the heavy chain framework region 2, e.g., as shown in FIG. 5A.

In some embodiments, the anti-TCRβV antibody molecule, e.g., anti-TCRβ V12 antibody molecule comprises the heavy chain framework region 3, e.g., as shown in FIG. 5A.

In some embodiments, the anti-TCRβV antibody molecule, e.g., anti-TCRβ V12 antibody molecule comprises the heavy chain framework region 4, e.g., as shown in FIG. 5A.

In some embodiments, the anti-TCRβV antibody molecule, e.g., anti-TCRβ V12 antibody molecule comprises the heavy chain framework regions 1-4, e.g., SEQ ID NOS: 20-23, or as shown in FIG. 5A.

In some embodiments, the anti-TCRβV antibody molecule, e.g., anti-TCRβ V12 antibody molecule comprises the light chain framework regions 1-4, e.g., SEQ ID NOs: 26-30, or as shown in FIG. 5B.

In some embodiments, the anti-TCRβV antibody molecule, e.g., anti-TCRβ V12 antibody molecule comprises the heavy chain framework regions 1-4, e.g., SEQ ID NOs: 23-25; and the light chain framework regions 1-4, e.g., SEQ ID NOs: 26-30, or as shown in FIGS. 5A and 5B.

In some embodiments, the heavy or light chain variable domain, or both, of, the anti-TCRβV antibody molecule, e.g., anti-TCRβ V12 antibody molecule includes an amino acid sequence, which is substantially identical to an amino acid disclosed herein, e.g., at least 80%, 85%, 90%, 92%, 95%, 97%, 98%, 99% or higher identical to a variable region of an antibody described herein, e.g., an antibody as described in Table 31, or encoded by the nucleotide sequence in Table 31; or which differs at least 1 or 5 residues, but less than 40, 30, 20, or 10 residues, from a variable region of an antibody described herein.

In some embodiments, the anti-TCRβV antibody molecule, e.g., anti-TCRβ V12 antibody molecule comprises at least one, two, three, or four antigen-binding regions, e.g., variable regions, having an amino acid sequence as set forth in Table 31, or a sequence substantially identical thereto (e.g., a sequence at least about 85%, 90%, 95%, 99% or more identical thereto, or which differs by no more than 1, 2, 5, 10, or 15 amino acid residues from the sequences shown in Table 31. In another embodiment, the anti-TCRβV antibody molecule, e.g., anti-TCRβ V12 antibody molecule includes a VH and/or VL domain encoded by a nucleic acid having a nucleotide sequence as set forth in Table 31, or a sequence substantially identical thereto (e.g., a sequence at least about 85%, 90%, 95%, 99% or more identical thereto, or which differs by no more than 3, 6, 15, 30, or 45 nucleotides from the sequences shown in Table 31.

In some embodiments, the anti-TCRβV antibody molecule, e.g., anti-TCRβ V12 antibody molecule comprises:

a VH domain comprising an amino acid sequence chosen from the amino acid sequence of SEQ ID NO: 23, SEQ ID NO:24 or SEQ ID NO:25, an amino acid sequence at least about 85%, 90%, 95%, 99% or more identical to the amino acid sequence SEQ ID NO: 23, SEQ ID NO:24 or SEQ ID NO:25, or an amino acid sequence which differs by no more than 1, 2, 5, 10, or 15 amino acid residues from the amino acid sequence of SEQ ID NO: 23, SEQ ID NO:24 or SEQ ID NO:25; and/or a VL domain comprising an amino acid sequence chosen from the amino acid sequence of SEQ ID NO: 26, SEQ ID NO: 27, SEQ ID NO: 28, SEQ ID NO: 29 or SEQ ID NO: 30, an amino acid sequence at least about 85%, 90%, 95%, 99% or more identical to the amino acid sequence of SEQ ID NO: 26, SEQ ID NO: 27, SEQ ID NO: 28, SEQ ID NO: 29 or SEQ ID NO: 30, or an amino acid sequence which differs by no more than 1, 2, 5, 10, or 15 amino acid residues from the amino acid sequence of SEQ ID NO: 26, SEQ ID NO: 27, SEQ ID NO: 28, SEQ ID NO: 29 or SEQ ID NO: 30.

In some embodiments, the anti-TCRβV antibody molecule, e.g., anti-TCRβ V12 antibody molecule comprises:

a VH domain comprising the amino acid sequence of SEQ ID NO: 23, an amino acid sequence at least about 85%, 90%, 95%, 99% or more identical to the amino acid sequence SEQ ID NO: 23, or an amino acid sequence which differs by no more than 1, 2, 5, 10, or 15 amino acid residues from the amino acid sequence of SEQ ID NO: 23; and a VL domain comprising the amino acid sequence of SEQ ID NO: 26, an amino acid sequence at least about 85%, 90%, 95%, 99% or more identical to the amino acid sequence SEQ ID NO: 26, or an amino acid sequence which differs by no more than 1, 2, 5, 10, or 15 amino acid residues from the amino acid sequence of SEQ ID NO: 26.

In some embodiments, the anti-TCRβV antibody molecule, e.g., anti-TCRβ V12 antibody molecule comprises:

a VH domain comprising the amino acid sequence of SEQ ID NO: 23, an amino acid sequence at least about 85%, 90%, 95%, 99% or more identical to the amino acid sequence SEQ ID NO: 23, or an amino acid sequence which differs by no more than 1, 2, 5, 10, or 15 amino acid residues from the amino acid sequence of SEQ ID NO: 23; and a VL domain comprising the amino acid sequence of SEQ ID NO: 27, an amino acid sequence at least about 85%, 90%, 95%, 99% or more identical to the amino acid sequence SEQ ID NO: 27, or an amino acid sequence which differs by no more than 1, 2, 5, 10, or 15 amino acid residues from the amino acid sequence of SEQ ID NO: 27.

In some embodiments, the anti-TCRβV antibody molecule, e.g., anti-TCRβ V12 antibody molecule comprises:

a VH domain comprising the amino acid sequence of SEQ ID NO: 23, an amino acid sequence at least about 85%, 90%, 95%, 99% or more identical to the amino acid sequence SEQ ID NO: 23, or an amino acid sequence which differs by no more than 1, 2, 5, 10, or 15 amino acid residues from the amino acid sequence of SEQ ID NO: 23; and a VL domain comprising the amino acid sequence of SEQ ID NO: 28, an amino acid sequence at least about 85%, 90%, 95%, 99% or more identical to the amino acid sequence SEQ ID NO: 28, or an amino acid sequence which differs by no more than 1, 2, 5, 10, or 15 amino acid residues from the amino acid sequence of SEQ ID NO: 28.

In some embodiments, the anti-TCRβV antibody molecule, e.g., anti-TCRβ V12 antibody molecule comprises:

a VH domain comprising the amino acid sequence of SEQ ID NO: 23, an amino acid sequence at least about 85%, 90%, 95%, 99% or more identical to the amino acid sequence SEQ ID NO: 23, or an amino acid sequence which differs by no more than 1, 2, 5, 10, or 15 amino acid residues from the amino acid sequence of SEQ ID NO: 23; and a VL domain comprising the amino acid sequence of SEQ ID NO: 29, an amino acid sequence at least about 85%, 90%, 95%, 99% or more identical to the amino acid sequence SEQ ID NO: 29, or an amino acid sequence which differs by no more than 1, 2, 5, 10, or 15 amino acid residues from the amino acid sequence of SEQ ID NO: 29.

In some embodiments, the anti-TCRβV antibody molecule, e.g., anti-TCRβ V12 antibody molecule comprises:

a VH domain comprising the amino acid sequence of SEQ ID NO: 23, an amino acid sequence at least about 85%, 90%, 95%, 99% or more identical to the amino acid sequence SEQ ID NO: 23, or an amino acid sequence which differs by no more than 1, 2, 5, 10, or 15 amino acid residues from the amino acid sequence of SEQ ID NO: 23; and a VL domain comprising the amino acid sequence of SEQ ID NO: 30, an amino acid sequence at least about 85%, 90%, 95%, 99% or more identical to the amino acid sequence SEQ ID NO: 30, or an amino acid sequence which differs by no more than 1, 2, 5, 10, or 15 amino acid residues from the amino acid sequence of SEQ ID NO: 30.

In some embodiments, the anti-TCRβV antibody molecule, e.g., anti-TCRβ V12 antibody molecule comprises:

a VH domain comprising the amino acid sequence of SEQ ID NO: 24, an amino acid sequence at least about 85%, 90%, 95%, 99% or more identical to the amino acid sequence SEQ ID NO: 24, or an amino acid sequence which differs by no more than 1, 2, 5, 10, or 15 amino acid residues from the amino acid sequence of SEQ ID NO: 24; and a VL domain comprising the amino acid sequence of SEQ ID NO: 26, an amino acid sequence at least about 85%, 90%, 95%, 99% or more identical to the amino acid sequence SEQ ID NO: 26, or an amino acid sequence which differs by no more than 1, 2, 5, 10, or 15 amino acid residues from the amino acid sequence of SEQ ID NO: 26.

In some embodiments, the anti-TCRβV antibody molecule, e.g., anti-TCRβ V12 antibody molecule comprises:

a VH domain comprising the amino acid sequence of SEQ ID NO: 24, an amino acid sequence at least about 85%, 90%, 95%, 99% or more identical to the amino acid sequence SEQ ID NO: 24, or an amino acid sequence which differs by no more than 1, 2, 5, 10, or 15 amino acid residues from the amino acid sequence of SEQ ID NO: 24; and a VL domain comprising the amino acid sequence of SEQ ID NO: 27, an amino acid sequence at least about 85%, 90%, 95%, 99% or more identical to the amino acid sequence SEQ ID NO: 27, or an amino acid sequence which differs by no more than 1, 2, 5, 10, or 15 amino acid residues from the amino acid sequence of SEQ ID NO: 27.

In some embodiments, the anti-TCRβV antibody molecule, e.g., anti-TCRβ V12 antibody molecule comprises:

a VH domain comprising the amino acid sequence of SEQ ID NO: 24, an amino acid sequence at least about 85%, 90%, 95%, 99% or more identical to the amino acid sequence SEQ ID NO: 24, or an amino acid sequence which differs by no more than 1, 2, 5, 10, or 15 amino acid residues from the amino acid sequence of SEQ ID NO: 24; and a VL domain comprising the amino acid sequence of SEQ ID NO: 28, an amino acid sequence at least about 85%, 90%, 95%, 99% or more identical to the amino acid sequence SEQ ID NO: 28, or an amino acid sequence which differs by no more than 1, 2, 5, 10, or 15 amino acid residues from the amino acid sequence of SEQ ID NO: 28.

In some embodiments, the anti-TCRβV antibody molecule, e.g., anti-TCRβ V12 antibody molecule comprises:

a VH domain comprising the amino acid sequence of SEQ ID NO: 24, an amino acid sequence at least about 85%, 90%, 95%, 99% or more identical to the amino acid sequence SEQ ID NO: 24, or an amino acid sequence which differs by no more than 1, 2, 5, 10, or 15 amino acid residues from the amino acid sequence of SEQ ID NO: 24; and a VL domain comprising the amino acid sequence of SEQ ID NO: 29, an amino acid sequence at least about 85%, 90%, 95%, 99% or more identical to the amino acid sequence SEQ ID NO: 29, or an amino acid sequence which differs by no more than 1, 2, 5, 10, or 15 amino acid residues from the amino acid sequence of SEQ ID NO: 29.

In some embodiments, the anti-TCRβV antibody molecule, e.g., anti-TCRβ V12 antibody molecule comprises:

a VH domain comprising the amino acid sequence of SEQ ID NO: 24, an amino acid sequence at least about 85%, 90%, 95%, 99% or more identical to the amino acid sequence SEQ ID NO: 24, or an amino acid sequence which differs by no more than 1, 2, 5, 10, or 15 amino acid residues from the amino acid sequence of SEQ ID NO: 24; and a VL domain comprising the amino acid sequence of SEQ ID NO: 30, an amino acid sequence at least about 85%, 90%, 95%, 99% or more identical to the amino acid sequence SEQ ID NO: 30, or an amino acid sequence which differs by no more than 1, 2, 5, 10, or 15 amino acid residues from the amino acid sequence of SEQ ID NO: 30.

In some embodiments, the anti-TCRβV antibody molecule, e.g., anti-TCRβ V12 antibody molecule comprises:

a VH domain comprising the amino acid sequence of SEQ ID NO: 25, an amino acid sequence at least about 85%, 90%, 95%, 99% or more identical to the amino acid sequence SEQ ID NO: 25, or an amino acid sequence which differs by no more than 1, 2, 5, 10, or 15 amino acid residues from the amino acid sequence of SEQ ID NO: 25; and a VL domain comprising the amino acid sequence of SEQ ID NO: 26, an amino acid sequence at least about 85%, 90%, 95%, 99% or more identical to the amino acid sequence SEQ ID NO: 26, or an amino acid sequence which differs by no more than 1, 2, 5, 10, or 15 amino acid residues from the amino acid sequence of SEQ ID NO: 26.

In some embodiments, the anti-TCRβV antibody molecule, e.g., anti-TCRβ V12 antibody molecule comprises:

a VH domain comprising the amino acid sequence of SEQ ID NO: 25, an amino acid sequence at least about 85%, 90%, 95%, 99% or more identical to the amino acid sequence SEQ ID NO: 25, or an amino acid sequence which differs by no more than 1, 2, 5, 10, or 15 amino acid residues from the amino acid sequence of SEQ ID NO: 25; and a VL domain comprising the amino acid sequence of SEQ ID NO: 27, an amino acid sequence at least about 85%, 90%, 95%, 99% or more identical to the amino acid sequence SEQ ID NO: 27, or an amino acid sequence which differs by no more than 1, 2, 5, 10, or 15 amino acid residues from the amino acid sequence of SEQ ID NO: 27.

In some embodiments, the anti-TCRβV antibody molecule, e.g., anti-TCRβ V12 antibody molecule comprises:

a VH domain comprising the amino acid sequence of SEQ ID NO: 25, an amino acid sequence at least about 85%, 90%, 95%, 99% or more identical to the amino acid sequence SEQ ID NO: 25, or an amino acid sequence which differs by no more than 1, 2, 5, 10, or 15 amino acid residues from the amino acid sequence of SEQ ID NO: 25; and a VL domain comprising the amino acid sequence of SEQ ID NO: 28, an amino acid sequence at least about 85%, 90%, 95%, 99% or more identical to the amino acid sequence SEQ ID NO: 28, or an amino acid sequence which differs by no more than 1, 2, 5, 10, or 15 amino acid residues from the amino acid sequence of SEQ ID NO: 28.

In some embodiments, the anti-TCRβV antibody molecule, e.g., anti-TCRβ V12 antibody molecule comprises:

a VH domain comprising the amino acid sequence of SEQ ID NO: 25, an amino acid sequence at least about 85%, 90%, 95%, 99% or more identical to the amino acid sequence SEQ ID NO: 25, or an amino acid sequence which differs by no more than 1, 2, 5, 10, or 15 amino acid residues from the amino acid sequence of SEQ ID NO: 25; and a VL domain comprising the amino acid sequence of SEQ ID NO: 29, an amino acid sequence at least about 85%, 90%, 95%, 99% or more identical to the amino acid sequence SEQ ID NO: 29, or an amino acid sequence which differs by no more than 1, 2, 5, 10, or 15 amino acid residues from the amino acid sequence of SEQ ID NO: 29.

In some embodiments, the anti-TCRβV antibody molecule, e.g., anti-TCRβ V12 antibody molecule comprises:

a VH domain comprising the amino acid sequence of SEQ ID NO: 25, an amino acid sequence at least about 85%, 90%, 95%, 99% or more identical to the amino acid sequence SEQ ID NO: 25, or an amino acid sequence which differs by no more than 1, 2, 5, 10, or 15 amino acid residues from the amino acid sequence of SEQ ID NO: 25; and a VL domain comprising the amino acid sequence of SEQ ID NO: 30, an amino acid sequence at least about 85%, 90%, 95%, 99% or more identical to the amino acid sequence SEQ ID NO: 30, or an amino acid sequence which differs by no more than 1, 2, 5, 10, or 15 amino acid residues from the amino acid sequence of SEQ ID NO: 30.

In some embodiments, the anti-TCRβV antibody molecule, e.g., anti-TCRβ V12 antibody molecule is a full antibody or fragment thereof (e.g., a Fab, $F(ab')_2$, Fv, or a single chain Fv fragment (scFv)). In embodiments, the anti-TCRβV antibody molecule, e.g., anti-TCRβ V6 (e.g., anti-TCRβ V6-5*01) antibody molecule is a monoclonal antibody or an antibody with single specificity. In some embodiments, the anti-TCRβV antibody molecule, e.g., anti-TCRβ V12 antibody molecule, can also be a humanized, chimeric, camelid, shark, or an in vitro-generated antibody molecule. In some embodiments, the anti-TCRβV antibody molecule, e.g., anti-TCRβ V12 antibody molecule is a humanized antibody molecule. The heavy and light chains of the anti-TCRβV antibody molecule, e.g., anti-TCRβ V12 antibody molecule can be full-length (e.g., an antibody can include at least one, and preferably two, complete heavy chains, and at least one, and preferably two, complete light chains) or can include an antigen-binding fragment (e.g., a Fab, F(ab')2, Fv, a single chain Fv fragment, a single domain antibody, a diabody (dAb), a bivalent antibody, or bispecific antibody or fragment thereof, a single domain variant thereof, or a camelid antibody).

In some embodiments, the anti-TCRβV antibody molecule, e.g., anti-TCRβ V12 antibody molecule is in the form of a multispecific molecule, e.g., a bispecific molecule, e.g., as described herein.

In some embodiments, the anti-TCRβV antibody molecule, e.g., anti-TCRβ V12 antibody molecule has a heavy chain constant region (Fc) chosen from, e.g., the heavy chain constant regions of IgG1, IgG2, IgG3, IgG4, IgM, IgA1, IgA2, IgD, and IgE. In some embodiments, the Fc region is chosen from the heavy chain constant regions of IgG1, IgG2, IgG3, and IgG4. In some embodiments, the Fc region is chosen from the heavy chain constant region of IgG1 or IgG2 (e.g., human IgG1, or IgG2). In some embodiments, the heavy chain constant region is human IgG1.

In some embodiments, the anti-TCRβV antibody molecule, e.g., anti-TCRβ V12 antibody molecule has a light chain constant region chosen from, e.g., the light chain constant regions of kappa or lambda, preferably kappa (e.g., human kappa). In one embodiment, the constant region is altered, e.g., mutated, to modify the properties of the anti-TCRβV antibody molecule, e.g., anti-TCRβ V12 antibody molecule (e.g., to increase or decrease one or more of: Fc receptor binding, antibody glycosylation, the number of cysteine residues, effector cell function, or complement function). For example, the constant region is mutated at positions 296 (M to Y), 298 (S to T), 300 (T to E), 477 (H to K) and 478 (N to F) to alter Fc receptor binding (e.g., the mutated positions correspond to positions 132 (M to Y), 134 (S to T), 136 (T to E), 313 (H to K) and 314 (N to F) of SEQ ID NOs: 212 or 214; or positions 135 (M to Y), 137 (S to T), 139 (T to E), 316 (H to K) and 317 (N to F) of SEQ ID NOs: 215, 216, 217 or 218).

TABLE 31

Amino acid and nucleotide sequences for murine and humanized antibody molecules. The antibody molecules include murine mAb 16G8 and humanized mAb 16G8. The amino acid the heavy and light chain CDRs, and the amino acid and nucleotide sequences of the heavy and light chain variable regions, and the heavy and light chains are shown.

16G8 (murine)

| | | |
|---|---|---|
| SEQ ID NO: 17 | HC CDR1 (Combined) | GFTFSNFGMH |
| SEQ ID NO: 18 | HC CDR2 (Combined) | YISSGSSTIYYADTLKG |
| SEQ ID NO: 19 | HC CDR3 (Combined) | RGEGAMDY |
| SEQ ID NO: 57 | HC CDR1 (Kabat) | NFGMH |
| SEQ ID NO: 58 | HC CDR2 (Kabat) | YISSGSSTIYYADTLKG |
| SEQ ID NO: 59 | HC CDR3 (Kabat) | RGEGAMDY |
| SEQ ID NO: 60 | HC CDR1 (Chothia) | GFTFSNF |
| SEQ ID NO: 61 | HC CDR2 (Chothia) | SSGSST |
| SEQ ID NO: 62 | HC CDR3 (Chothia) | RGEGAMDY |
| SEQ ID NO: 15 | VH | DVQLVESGGGLVQPGGSRKLSCAASGFTFSNFGMH WVRQAPDKGLEWVAYISSGSSTIYYADTLKGRFTIS RDNPKNTLFLQMTSLRSEDTAMYYCARRGEGAMD YWGQGTSVTVSS |
| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3 (Combined) | QQFTSSPFT |
| SEQ ID NO: 63 | LC CDR1 (Kabat) | RASSSVNYIY |
| SEQ ID NO: 64 | LC CDR2 (Kabat) | YTSNLAP |
| SEQ ID NO: 65 | LC CDR3 (Kabat) | QQFTSSPFT |
| SEQ ID NO: 66 | LC CDR1 (Chothia) | RASSSVNYIY |
| SEQ ID NO: 67 | LC CDR2 (Chothia) | YTSNLAP |
| SEQ ID NO: 68 | LC CDR3 (Chothia) | QQFTSSPFT |
| SEQ ID NO: 16 | VL | ENVLTQSPAIMSASLGEKVTMSCRASSSVNYIYWY QQKSDASPKLWIYYTSNLAPGVPTRFSGSGSGNSYS LTISSMEGEDAATYYCQQFTSSPFTFGSGTKLEIK |

16G8 humanized HC-1

| | | |
|---|---|---|
| SEQ ID NO: 17 | HC CDR1 (Combined) | GFTFSNFGMH |
| SEQ ID NO: 18 | HC CDR2 (Combined) | YISSGSSTIYYADTLKG |
| SEQ ID NO: 19 | HC CDR3 (Combined) | RGEGAMDY |
| SEQ ID NO: 23 | VH | EVQLVESGGGLVQPGGSLRLSCAASGFTFSNFGMH WVRQAPGKGLEWVSYISSGSSTIYYADTLKGRFTIS RDNAKNSLYLQMNSLRAEDTAVYYCARRGEGAMD YWGQGTTVTVSS |
| SEQ ID NO: 31 | DNA VH | GAGGTGCAGCTGGTTGAATCTGGCGGAGGATTGG TTCAGCCTGGCGGCTCTCTGAGACTGTCTTGTGCC GCTTCTGGCTTCACCTTCTCCAACTTCGGCATGCA CTGGGTCCGACAGGCCCCTGGAAAAGGACTGGAA TGGGTGTCCTACATCTCCTCCGGCTCCTCCACCAT CTACTACGCTGACACCCTGAAGGGCAGATTCACC ATCTCTCGGGACAACGCCAAGAACTCCCTGTACC TGCAGATGAACAGCCTGAGAGCCGAGGACACCG CCGTGTACTACTGTGCTAGAAGAGGCGAGGGCGC CATGGATTATTGGGGCCAGGGAACCACAGTGACC GTGTCTAGC |

16G8 humanized HC-2

| | | |
|---|---|---|
| SEQ ID NO: 17 | HC CDR1 (Combined) | GFTFSNFGMH |
| SEQ ID NO: 18 | HC CDR2 (Combined) | YISSGSSTIYYADTLKG |
| SEQ ID NO: 19 | HC CDR3 (Combined) | RGEGAMDY |
| SEQ ID NO: 24 | VH | EVQLVESGGGLVQPGGSLRLSCAASGFTFSNFGMH WVRQAPGKGLEWVSYISSGSSTIYYADTLKGRFTIS RDNSKNTLYLQMNSLRAEDTAVYYCARRGEGAMD YWGQGTTVTVSS |
| SEQ ID NO: 32 | DNA VH | GAGGTGCAGCTGGTTGAATCTGGCGGAGGATTGG TTCAGCCTGGCGGCTCTCTGAGACTGTCTTGTGCC GCTTCTGGCTTCACCTTCTCCAACTTCGGCATGCA CTGGGTCCGACAGGCCCCTGGAAAAGGACTGGAA TGGGTGTCCTACATCTCCTCCGGCTCCTCCACCAT CTACTACGCTGACACCCTGAAGGGCAGATTCACC ATCAGCCGGGACAACTCCAAGAACACCCTGTACC TGCAGATGAACTCCCTGAGAGCCGAGGACACCGC CGTGTACTACTGTGCTAGAAGAGGCGAGGGCGCC ATGGATTATTGGGGCCAGGGAACCACAGTGACCG TGTCTAGC |

TABLE 31-continued

Amino acid and nucleotide sequences for murine and humanized antibody molecules. The antibody molecules include murine mAb 16G8 and humanized mAb 16G8. The amino acid the heavy and light chain CDRs, and the amino acid and nucleotide sequences of the heavy and light chain variable regions, and the heavy and light chains are shown.

16G8 humanized HC-3

| | | |
|---|---|---|
| SEQ ID NO: 17 | HC CDR1 (Combined) | GFTFSNFGMH |
| SEQ ID NO: 18 | HC CDR2 (Combined) | YISSGSSTIYYADTLKG |
| SEQ ID NO: 19 | HC CDR3 (Combined) | RGEGAMDY |
| SEQ ID NO: 25 | VH | QVQLVESGGGVVQPGRSLRLSCAASGFTFSNFGMH WVRQAPGKGLEWVAYISSGSSTIYYADTLKGRFTIS RDNSKNTLYLQMNSLRAEDTAVYYCARRGEGAMD YWGQGTTVTVSS |
| SEQ ID NO: 33 | DNA VH | CAGGTGCAGCTGGTGGAATCTGGTGGCGGAGTTG TGCAGCCTGGCAGATCCCTGAGACTGTCTTGTGC CGCCTCTGGCTTCACCTTCTCCAACTTCGGCATGC ACTGGGTCCGACAGGCCCCTGGAAAAGGATTGGA GTGGGTCGCCTACATCTCCTCCGGCTCCTCCACCA TCTACTACGCTGACACCCTGAAGGGCAGATTCAC CATCAGCCGGGACAACTCCAAGAACACCCTGTAC CTGCAGATGAACTCCCTGAGAGCCGAGGACACCG CCGTGTACTACTGTGCTAGAAGAGGCGAGGGCGC CATGGATTATTGGGGCCAGGGAACCACAGTGACC GTGTCTAGC |

16G8 humanized LC-1

| | | |
|---|---|---|
| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3 (Combined) | QQFTSSPFT |
| SEQ ID NO: 26 | VL | DNQLTQSPSFLSASVGDRVTITCRASSSVNYIYWYQ QKPGKAPKLLIYYTSNLAPGVPSRFSGSGSGNEYTL TISSLQPEDFATYYCQQFTSSPFTFGQGTKLEIK |
| SEQ ID NO: 34 | DNA VL | GATAACCAGCTGACCCAGTCTCCTAGCTTCCTGTC TGCCTCTGTGGGCGACAGAGTGACAATTACCTGC CGGGCCTCCTCCTCCGTGAACTACATCTACTGGTA TCAGCAGAAGCCCGGCAAGGCCCCTAAGCTGCTG ATCTACTACACCTCCAATCTGGCCCCTGGCGTGCC CTCTAGATTTTCCGGATCTGGCTCCGGCAACGAGT ATACCCTGACAATCTCCAGCCTGCAGCCTGAGGA CTTCGCCACCTACTACTGCCAGCAGTTCACCTCCT CTCCATTCACCTTTGGCCAGGGCACCAAGCTGGA AATCAAA |

16G8 humanized LC-2

| | | |
|---|---|---|
| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3 (Combined) | QQFTSSPFT |
| SEQ ID NO: 27 | VL | DNQLTQSPSSLSASVGDRVTITCRASSSVNYIYWYQ QKPGKAPKLLIYYTSNLAPGVPSRFSGSGSGNDYTL TISSLQPEDFATYYCQQFTSSPFTFGQGTKLEIK |
| SEQ ID NO: 35 | DNA VL | ATAACCAGCTGACCCAGTCTCCTTCCAGCCTGTCT GCTTCTGTGGGCGACAGAGTGACAATTACCTGCC GGGCCTCCTCCTCCGTGAACTACATCTACTGGTAT CAGCAGAAGCCCGGCAAGGCCCCTAAGCTGCTGA TCTACTACACCTCCAATCTGGCCCCTGGCGTGCCC TCTAGATTTTCCGGATCTGGCTCCGGCAACGACTA TACCCTGACAATCTCCAGCCTGCAGCCTGAGGAC TTCGCCACCTACTACTGCCAGCAGTTCACCTCCTC TCCATTCACCTTTGGCCAGGGCACCAAGCTGGAA ATCAAA |

16G8 humanized LC-3

| | | |
|---|---|---|
| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3 (Combined) | QQFTSSPFT |
| SEQ ID NO: 28 | VL | ENVLTQSPATLSVSPGERATLSCRASSSVNYIYWYQ QKPGQAPRLLIYYTSNLAPGIPARFSGSGSGNEYTLT ISSLQSEDFAVYYCQQFTSSPFTFGQGTKLEIK |
| SEQ ID NO: 36 | DNA VL | GAGAATGTGCTGACCCAGTCTCCTGCCACACTGT CTGTTAGCCCTGGCGAGAGAGCTACCCTGAGCTG CAGAGCCTCTTCCTCCGTGAACTACATCTACTGGT ATCAGCAGAAGCCCGGCCAGGCTCCTAGACTGCT GATCTACTACACCTCCAATCTGGCCCCTGGCATCC |

TABLE 31-continued

Amino acid and nucleotide sequences for murine and humanized antibody molecules. The antibody molecules include murine mAb 16G8 and humanized mAb 16G8. The amino acid the heavy and light chain CDRs, and the amino acid and nucleotide sequences of the heavy and light chain variable regions, and the heavy and light chains are shown.

| | | |
|---|---|---|
| | | CTGCCAGATTTTCCGGATCTGGCTCCGGCAACGA GTATACCCTGACCATCTCCAGCCTGCAGTCCGAG GACTTTGCTGTGTACTATTGCCAGCAGTTCACAAG CAGCCCTTTCACCTTTGGCCAGGGCACCAAGCTG GAAATCAAA |
| **16G8 humanized LC-4** | | |
| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3 (Combined) | QQFTSSPFT |
| SEQ ID NO: 29 | VL | QNVLTQPPSASGTPGQRVTISCRASSSVNYIYWYQQ LPGTAPKLLIYYTSNLAPGVPDRFSGSGSGNSYSLAI SGLRSEDEADYYCQQFTSSPFTFGTGTKVTVL |
| SEQ ID NO: 37 | DNA VL | CAGAATGTGCTGACCCAACCTCCTTCCGCCTCTGG CACACCTGGACAGAGAGTGACAATCTCCTGCCGG GCCTCCTCCTCCGTGAACTACATCTACTGGTATCA GCAGCTGCCCGGCACCGCTCCTAAACTGCTGATC TACTACACCTCCAATCTGGCCCCTGGCGTGCCCG ATAGATTTTCCGGATCTGGCTCCGGCAACTCCTAC AGCCTGGCTATCTCTGGCCTGAGATCTGAGGACG AGGCCGACTACTACTGCCAGCAGTTCACCTCCTCT CCATTCACCTTTGGCACCGGCACCAAAGTGACAG TTCTT |
| **16G8 humanized LC-5** | | |
| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3 (Combined) | QQFTSSPFT |
| SEQ ID NO: 30 | VL | SNELTQPPSVSVSPGQTARITCRASSSVNYIYWYQQ KSGQAPVLVIYYTSNLAPGIPERFSGSGSGNMYTLTI SGAQVEDEADYYCQQFTSSPFTFGTGTKVTVL |
| SEQ ID NO: 38 | DNA VL | TCTAATGAGCTGACCCAGCCTCCTTCCGTGTCCGT GTCTCCTGGACAGACCGCCAGAATTACCTGCCGG GCCTCCTCCTCCGTGAACTACATCTACTGGTATCA GCAGAAGTCCGGCCAGGCTCCTGTGCTCGTGATC TACTACACCTCCAATCTGGCCCCTGGCATCCCTGA GAGATTCTCCGGATCTGGCTCCGGCAACATGTAC ACCCTGACCATCTCTGGCGCCCAGGTGGAAGATG AGGCCGACTACTACTGCCAGCAGTTCACCTCCTCT CCATTCACCTTTGGCACCGGCACCAAAGTGACAG TTCTT |

TABLE 32

Constant region amino acid sequences of human IgG heavy chains and human kappa light chain

| | | |
|---|---|---|
| Human kappa constant region SEQ ID NO: 39 | LC | RTVAAPSVFI FPPSDEQLKS GTASVVCLLN NFYPREAKVQ WKVDNALQSG NSQESVTEQD SKDSTYSLSS TLTLSKADYE KHKVYACEVT HQGLSSPVTK SFNRGEC |
| IgG4 (S228P) mutant constant region (EU Numbering) SEQ ID NO: 40 | HC | ASTKGPSVFPLAPCSRSTSESTAALGCLVKDYFPEPVTVSWNSGALTSG VHTFPAVLQSSGLYSLSSVVTVPSSSLGTKTYTCNVDHKPSNTKVDKR VESKYGPPCPPCPAPEFLGGPSVFLFPPKPKDTLMISRTPEVTCVVVDVS QEDPEVQFNWYVDGVEVHNAKTKPREEQFNSTYRVVSVLTVLHQDW LNGKEYKCKVSNKGLPSSIEKTISKAKGQPREPQVYTLPPSQEEMTKNQ VSLTCLVKGFYPSDIAVEWESNGQPENNYKTTPPVLDSDGSFFLYSRLT VDKSRWQEGNVFSCSVMHEALHNHYTQKSLSLSLG |
| IgG1 wild type SEQ ID NO: 41 | HC | ASTKGPSVFPLAPSSKSTSGGTAALGCLVKDYFPEPVTVSWNSGALTSG VHTFPAVLQSSGLYSLSSVVTVPSSSLGTQTYICNVNHKPSNTKVDKRV EPKSCDKTHTCPPCPAPELLGGPSVFLFPPKPKDTLMISRTPEVTCVVVD VSHEDPEVKFNWYVDGVEVHNAKTKPREEQYNSTYRVVSVLTVLHQ DWLNGKEYKCKVSNKALPAPIEKTISKAKGQPREPQVYTLPPSREEMT KNQVSLTCLVKGFYPSDIAVEWESNGQPENNYKTTPPVLDSDGSFFLY SKLTVDKSRWQQGNVFSCSVMHEALHNHYTQKSLSLSPGK |

TABLE 32-continued

| Constant region amino acid sequences of human IgG heavy chains and human kappa light chain | | |
|---|---|---|
| IgG1 (N297A) mutant constant region (EU Numbering) SEQ ID NO: 42 | HC | ASTKGPSVFPLAPSSKSTSGGTAALGCLVKDYFPEPVTVSWNSGALTSG VHTFPAVLQSSGLYSLSSVVTVPSSSLGTQTYICNVNHKPSNTKVDKRV EPKSCDKTHTCPPCPAPELLGGPSVFLFPPKPKDTLMISRTPEVTCVVVD VSHEDPEVKFNWYVDGVEVHNAKTKPREEQYASTYRVVSVLTVLHQ DWLNGKEYKCKVSNKALPAPIEKTISKAKGQPREPQVYTLPPSREEMT KNQVSLTCLVKGFYPSDIAVEWESNGQPENNYKTTPPVLDSDGSFFLY SKLTVDKSRWQQGNVFSCSVMHEALHNHYTQKSLSLSPGK |

B Cell, Macrophage & Dendritic Cell Engagers

Broadly, B cells, also known as B lymphocytes, are a type of white blood cell of the lymphocyte subtype. They function in the humoral immunity component of the adaptive immune system by secreting antibodies. Additionally, B cells present antigen (they are also classified as professional antigen-presenting cells (APCs)) and secrete cytokines. Macrophages are a type of white blood cell that engulfs and digests cellular debris, foreign substances, microbes, cancer cells via phagocytosis. Besides phagocytosis, they play important roles in nonspecific defense (innate immunity) and also help initiate specific defense mechanisms (adaptive immunity) by recruiting other immune cells such as lymphocytes. For example, they are important as antigen presenters to T cells. Beyond increasing inflammation and stimulating the immune system, macrophages also play an important anti-inflammatory role and can decrease immune reactions through the release of cytokines. Dendritic cells (DCs) are antigen-presenting cells that function in processing antigen material and present it on the cell surface to the T cells of the immune system.

The present disclosure provides, inter alia, multispecific (e.g., bi-, tri-, quad-specific) or multifunctional molecules, that include, e.g., are engineered to contain, one or more B cell, macrophage, and/or dendritic cell engager that mediate binding to and/or activation of a B cell, macrophage, and/or dendritic cell.

Accordingly, in some embodiments, the immune cell engager comprises a B cell, macrophage, and/or dendritic cell engager chosen from one or more of CD40 ligand (CD40L) or a CD70 ligand; an antibody molecule that binds to CD40 or CD70; an antibody molecule to OX40; an OX40 ligand (OX40L); an agonist of a Toll-like receptor (e.g., as described herein, e.g., a TLR4, e.g., a constitutively active TLR4 (caTLR4), or a TLR9 agonists); a 41BB; a CD2; a CD47; or a STING agonist, or a combination thereof.

In some embodiments, the B cell engager is a CD40L, an OX40L, or a CD70 ligand, or an antibody molecule that binds to OX40, CD40 or CD70.

In some embodiments, the macrophage engager is a CD2 agonist. In some embodiments, the macrophage engager is an antigen binding domain that binds to: CD40L or antigen binding domain or ligand that binds CD40, a Toll like receptor (TLR) agonist (e.g., as described herein), e.g., a TLR9 or TLR4 (e.g., caTLR4 (constitutively active TLR4), CD47, or a STING agonist. In some embodiments, the STING agonist is a cyclic dinucleotide, e.g., cyclic di-GMP (cdGMP) or cyclic di-AMP (cdAMP). In some embodiments, the STING agonist is biotinylated.

In some embodiments, the dendritic cell engager is a CD2 agonist. In some embodiments, the dendritic cell engager is a ligand, a receptor agonist, or an antibody molecule that binds to one or more of: OX40L, 41BB, a TLR agonist (e.g., as described herein) (e.g., TLR9 agonist, TLR4 (e.g., caTLR4 (constitutively active TLR4)), CD47, or and a STING agonist. In some embodiments, the STING agonist is a cyclic dinucleotide, e.g., cyclic di-GMP (cdGMP) or cyclic di-AMP (cdAMP). In some embodiments, the STING agonist is biotinylated.

In other embodiments, the immune cell engager mediates binding to, or activation of, one or more of a B cell, a macrophage, and/or a dendritic cell. Exemplary B cell, macrophage, and/or dendritic cell engagers can be chosen from one or more of CD40 ligand (CD40L) or a CD70 ligand; an antibody molecule that binds to CD40 or CD70; an antibody molecule to OX40; an OX40 ligand (OX40L); a Toll-like receptor agonist (e.g., a TLR4, e.g., a constitutively active TLR4 (caTLR4) or a TLR9 agonist); a 41BB agonist; a CD2; a CD47; or a STING agonist, or a combination thereof.

In some embodiments, the B cell engager is chosen from one or more of a CD40L, an OX40L, or a CD70 ligand, or an antibody molecule that binds to OX40, CD40 or CD70.

In other embodiments, the macrophage cell engager is chosen from one or more of a CD2 agonist; a CD40L; an OX40L; an antibody molecule that binds to OX40, CD40 or CD70; a Toll-like receptor agonist or a fragment thereof (e.g., a TLR4, e.g., a constitutively active TLR4 (caTLR4)); a CD47 agonist; or a STING agonist.

In other embodiments, the dendritic cell engager is chosen from one or more of a CD2 agonist, an OX40 antibody, an OX40L, 41BB agonist, a Toll-like receptor agonist or a fragment thereof (e.g., a TLR4, e.g., a constitutively active TLR4 (caTLR4)), CD47 agonist, or a STING agonist.

In one embodiment, the OX40L comprises the amino acid sequence:

(SEQ ID NO: 7245)
QVSHRYPRIQSIKVQFTEYKKEKGFILTSQKEDEIMKVQNNSVIINCDG

FYLISLKGYFSQEVNISLHYQKDEEPLFQLKKVRSVNSLMVASLTYKDK

VYLNVTTDNTSLDDFHVNGGELILIHQNPGEFCVL, a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7245.

In another embodiment, the CD40L comprises the amino acid sequence:

```
                                    (SEQ ID NO: 7246)
MQKGDQNPQIAAHVISEASSKTTSVLQWAEKGYYTMSNNLVTLENGKQL

TVKRQGLYYIYAQVTFCSNREASSQAPFIASLCLKSPGRFERILLRAAN

THSSAKPCGQQSIHLGGVFELQPGASVFVNVTDPSQVSHGTGFTSFGLL

KL,
```

a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7246.

In yet other embodiments, the STING agonist comprises a cyclic dinucleotide, e.g., a cyclic di-GMP (cdGMP), a cyclic di-AMP (cdAMP), or a combination thereof, optionally with 2',5' or 3',5' phosphate linkages.

In one embodiment, the immune cell engager includes 41BB ligand, e.g., comprising the amino acid sequence:

```
                                    (SEQ ID NO: 7247)
ACPWAVSGARASPGSAASPRLREGPELSPDDPAGLLDLRQGMFAQLVAQ

NVLLIDGPLSWYSDPGLAGVSLTGGLSYKEDTKELVVAKAGVYYVFFQL

ELRRVVAGEGSGSVSLALHLQPLRSAAGAAALALTVDLPPASSEARNSA

FGFQGRLLHLSAGQRLGVHLHTEARARHAWQLTQGATVLGLFRVTPEIP

AGLPSPRSE,
```

a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7247.

Toll-Like Receptors

Toll-Like Receptors (TLRs) are evolutionarily conserved receptors are homologues of the Drosophila Toll protein, and recognize highly conserved structural motifs known as pathogen-associated microbial patterns (PAMPs), which are exclusively expressed by microbial pathogens, or danger-associated molecular patterns (DAMPs) that are endogenous molecules released from necrotic or dying cells. PAMPs include various bacterial cell wall components such as lipopolysaccharide (LPS), peptidoglycan (PGN) and lipopeptides, as well as flagellin, bacterial DNA and viral double-stranded RNA. DAMPs include intracellular proteins such as heat shock proteins as well as protein fragments from the extracellular matrix. Stimulation of TLRs by the corresponding PAMPs or DAMPs initiates signaling cascades leading to the activation of transcription factors, such as AP-1, NF-κB and interferon regulatory factors (IRFs). Signaling by TLRs results in a variety of cellular responses, including the production of interferons (IFNs), pro-inflammatory cytokines and effector cytokines that direct the adaptive immune response. TLRs are implicated in a number of inflammatory and immune disorders and play a role in cancer (Rakoff-Nahoum S. & Medzhitov R., 2009. Toll-like receptors and cancer. Nat Revs Cancer 9:57-63.)

TLRs are type I transmembrane proteins characterized by an extracellular domain containing leucine-rich repeats (LRRs) and a cytoplasmic tail that contains a conserved region called the Toll/IL-1 receptor (TIR) domain. Ten human and twelve murine TLRs have been characterized, TLR1 to TLR10 in humans, and TLR1 to TLR9, TLR11, TLR12 and TLR13 in mice, the homolog of TLR10 being a pseudogene. TLR2 is essential for the recognition of a variety of PAMPs from Gram-positive bacteria, including bacterial lipoproteins, lipomannans and lipoteichoic acids. TLR3 is implicated in virus-derived double-stranded RNA. TLR4 is predominantly activated by lipopolysaccharide. TLR5 detects bacterial flagellin and TLR9 is required for response to unmethylated CpG DNA. Finally, TLR7 and TLR8 recognize small synthetic antiviral molecules, and single-stranded RNA was reported to be their natural ligand. TLR11 has been reported to recognize uropathogenic *E. coli* and a profilin-like protein from *Toxoplasma gondii*. The repertoire of specificities of the TLRs is apparently extended by the ability of TLRs to heterodimerize with one another. For example, dimers of TLR2 and TLR6 are required for responses to diacylated lipoproteins while TLR2 and TLR1 interact to recognize triacylated lipoproteins. Specificities of the TLRs are also influenced by various adapter and accessory molecules, such as MD-2 and CD14 that form a complex with TLR4 in response to LPS.

TLR signaling consists of at least two distinct pathways: a MyD88-dependent pathway that leads to the production of inflammatory cytokines, and a MyD88-independent pathway associated with the stimulation of IFN-β and the maturation of dendritic cells. The MyD88-dependent pathway is common to all TLRs, except TLR3 (Adachi O. et al., 1998. Targeted disruption of the MyD88 gene results in loss of IL-1- and IL-18-mediated function. Immunity. 9(1):143-50). Upon activation by PAMPs or DAMPs, TLRs hetero- or homodimerize inducing the recruitment of adaptor proteins via the cytoplasmic TIR domain. Individual TLRs induce different signaling responses by usage of the different adaptor molecules. TLR4 and TLR2 signaling requires the adaptor TIRAP/Mal, which is involved in the MyD88-dependent pathway. TLR3 triggers the production of IFN-β in response to double-stranded RNA, in a MyD88-independent manner, through the adaptor TRIF/TICAM-1. TRAM/TICAM-2 is another adaptor molecule involved in the MyD88-independent pathway which function is restricted to the TLR4 pathway.

TLR3, TLR7, TLR8 and TLR9 recognize viral nucleic acids and induce type I IFNs. The signaling mechanisms leading to the induction of type I IFNs differ depending on the TLR activated. They involve the interferon regulatory factors, IRFs, a family of transcription factors known to play a critical role in antiviral defense, cell growth and immune regulation. Three IRFs (IRF3, IRF5 and IRF7) function as direct transducers of virus-mediated TLR signaling. TLR3 and TLR4 activate IRF3 and IRF7, while TLR7 and TLR8 activate IRF5 and IRF7 (Doyle S. et al., 2002. IRF3 mediates a TLR3/TLR4-specific antiviral gene program. Immunity. 17(3):251-63). Furthermore, type I IFN production stimulated by TLR9 ligand CpG-A has been shown to be mediated by PI(3)K and mTOR (Costa-Mattioli M. & Sonenberg N. 2008. RAPping production of type I interferon in pDCs through mTOR. Nature Immunol. 9: 1097-1099).

TLR-9

TLR9 recognizes unmethylated CpG sequences in DNA molecules. CpG sites are relatively rare (~1%) on vertebrate genomes in comparison to bacterial genomes or viral DNA. TLR9 is expressed by numerous cells of the immune system such as B lymphocytes, monocytes, natural killer (NK) cells, and plasmacytoid dendritic cells. TLR9 is expressed intracellularly, within the endosomal compartments and functions to alert the immune system of viral and bacterial infections by binding to DNA rich in CpG motifs. TLR9 signals leads to activation of the cells initiating pro-inflammatory reactions that result in the production of cytokines such as type-I interferon and IL-12.

TLR Agonists

A TLR agonist can agonize one or more TLR, e.g., one or more of human TLR-1, 2, 3, 4, 5, 6, 7, 8, 9, or 10. In some embodiments, an adjunctive agent described herein is a TLR agonist. In some embodiments, the TLR agonist specifically agonizes human TLR-9. In some embodiments, the TLR-9 agonist is a CpG moiety. As used herein, a CpG moiety, is a linear dinucleotide having the sequence: 5'-C-phosphate-G-3', that is, cytosine and guanine separated by only one phosphate.

In some embodiments, the CpG moiety comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more CpG dinucleotides. In some embodiments, the CpG moiety consists of 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 CpG dinucleotides. In some embodiments, the CpG moiety has 1-5, 1-10, 1-20, 1-30, 1-40, 1-50, 5-10, 5-20, 5-30, 10-20, 10-30, 10-40, or 10-50 CpG dinucleotides.

In some embodiments, the TLR-9 agonist is a synthetic ODN (oligodeoxynucleotides). CpG ODNs are short synthetic single-stranded DNA molecules containing unmethylated CpG dinucleotides in particular sequence contexts (CpG motifs). CpG ODNs possess a partially or completely phosphorothioated (PS) backbone, as opposed to the natural phosphodiester (PO) backbone found in genomic bacterial DNA. There are three major classes of CpG ODNs: classes A, B and C, which differ in their immunostimulatory activities. CpG-A ODNs are characterized by a PO central CpG-containing palindromic motif and a PS-modified 3' poly-G string. They induce high IFN-α production from pDCs but are weak stimulators of TLR9-dependent NF-κB signaling and pro-inflammatory cytokine (e.g. IL-6) production. CpG-B ODNs contain a full PS backbone with one or more CpG dinucleotides. They strongly activate B cells and TLR9-dependent NF-κB signaling but weakly stimulate IFN-α secretion. CpG-C ODNs combine features of both classes A and B. They contain a complete PS backbone and a CpG-containing palindromic motif C-Class CpG ODNs induce strong IFN-α production from pDC as well as B cell stimulation.

Stromal Modifying Moieties

Solid tumors have a distinct structure that mimics that of normal tissues and comprises two distinct but interdependent compartments: the parenchyma (neoplastic cells) and the stroma that the neoplastic cells induce and in which they are dispersed. All tumors have stroma and require stroma for nutritional support and for the removal of waste products. In the case of tumors which grow as cell suspensions (e.g., leukemias, ascites tumors), the blood plasma serves as stroma (Connolly J L et al. Tumor Structure and Tumor Stroma Generation. In: Kufe D W et al., editors. Holland-Frei *Cancer Medicine*. 6th edition. Hamilton: BC Decker; 2003). The stroma includes a variety of cell types, including fibroblasts/myofibroblasts, glial, epithelial, fat, vascular, smooth muscle, and immune cells along with extracellular matrix (ECM) and extracellular molecules (Li Hanchen et al. Tumor Microenvironment: The Role of the Tumor Stroma in Cancer. *J of Cellular Biochemistry* 101: 805-815 (2007)).

Stromal modifying moieties described herein include moieties (e.g., proteins, e.g., enzymes) capable of degrading a component of the stroma, e.g., an ECM component, e.g., a glycosaminoglycan, e.g., hyaluronan (also known as hyaluronic acid or HA), chondroitin sulfate, chondroitin, dermatan sulfate, heparin sulfate, heparin, entactin, tenascin, aggrecan and keratin sulfate; or an extracellular protein, e.g., collagen, laminin, elastin, fibrinogen, fibronectin, and vitronectin.

Stromal Modifying Enzymes

In some embodiments, the stromal modifying moiety is an enzyme. For example, the stromal modifying moiety can include, but is not limited to a hyaluronidase, a collagenase, a chondroitinase, a matrix metalloproteinase (e.g., macrophage metalloelastase).

Hyaluronidases

Hyaluronidases are a group of neutral- and acid-active enzymes found throughout the animal kingdom. Hyaluronidases vary with respect to substrate specificity, and mechanism of action. There are three general classes of hyaluronidases: (1) Mammalian-type hyaluronidases, (EC 3.2.1.35) which are endo-beta-N-acetylhexosaminidases with tetrasaccharides and hexasaccharides as the major end products. They have both hydrolytic and transglycosidase activities, and can degrade hyaluronan and chondroitin sulfates; (2) Bacterial hyaluronidases (EC 4.2.99.1) degrade hyaluronan and, and to various extents, chondroitin sulfate and dermatan sulfate. They are endo-beta-N-acetylhexosaminidases that operate by a beta elimination reaction that yields primarily disaccharide end products; (3) Hyaluronidases (EC 3.2.1.36) from leeches, other parasites, and crustaceans are endo-beta-glucuronidases that generate tetrasaccharide and hexasaccharide end products through hydrolysis of the beta 1-3 linkage.

Mammalian hyaluronidases can be further divided into two groups: (1) neutral active and (2) acid active enzymes. There are six hyaluronidase-like genes in the human genome, HYAL1, HYAL2, HYAL3 HYAL4 HYALP1 and PH20/SPAM1. HYALP1 is a pseudogene, and HYAL3 has not been shown to possess enzyme activity toward any known substrates. HYAL4 is a chondroitinase and lacks activity towards hyaluronan. HYAL1 is the prototypical acid-active enzyme and PH20 is the prototypical neutral-active enzyme. Acid active hyaluronidases, such as HYAL1 and HYAL2 lack catalytic activity at neutral pH. For example, HYAL1 has no catalytic activity in vitro over pH 4.5 (Frost and Stem, "A Microtiter-Based Assay for Hyaluronidase Activity Not Requiring Specialized Reagents", Analytical Biochemistry, vol. 251, pp. 263-269 (1997). HYAL2 is an acid active enzyme with a very low specific activity in vitro.

In some embodiments the hyaluronidase is a mammalian hyaluronidase. In some embodiments the hyaluronidase is a recombinant human hyaluronidase. In some embodiments, the hyaluronidase is a neutral active hyaluronidase. In some embodiments, the hyaluronidase is a neutral active soluble hyaluronidase. In some embodiments, the hyaluronidase is a recombinant PH20 neutral-active enzyme. In some embodiments, the hyaluronidase is a recombinant PH20 neutral-active soluble enzyme. In some embodiments the hyaluronidase is glycosylated. In some embodiments, the hyaluronidase possesses at least one N-linked glycan. A recombinant hyaluronidase can be produced using conventional methods known to those of skill in the art, e.g., U.S. Pat. No. 7,767,429, the entire contents of which are incorporated by reference herein.

In some embodiments the hyaluronidase is rHuPH20 (also referred to as Hylenex®; presently manufactured by Halozyme; approved by the FDA in 2005 (see e.g., Scodeller P (2014) Hyaluronidase and other Extracellular Matrix Degrading Enzymes for Cancer Therapy: New Uses and Nano-Formulations. *J Carcinog Mutage* 5:178; U.S. Pat. Nos. 7,767,429; 8,202,517; 7,431,380; 8,450,470; 8,772, 246; 8,580,252, the entire contents of each of which is incorporated by reference herein). rHuPH20 is produced by genetically engineered CHO cells containing a DNA plasmid encoding for a soluble fragment of human hyaluronidase PH20. In some embodiments the hyaluronidase is glycosylated. In some embodiments, the hyaluronidase possesses at least one N-linked glycan. A recombinant hyaluronidase can be produced using conventional methods known to those of skill in the art, e.g., U.S. Pat. No. 7,767,429, the entire contents of which are incorporated by reference herein. In some embodiments, rHuPH20 has a sequence at least 95% (e.g., at least 96%, 97%, 98%, 99%, 100%) identical to the amino acid sequence of

```
                                      (SEQ ID NO: 7248)
LNFRAPPVIPNVPFLWAWNAPSEFCLGKFDEPLDMSLFSFIGSPRINAT

GQGVTIFYVDRLGYYPYIDSITGVTVNGGIPQKISLQDHLDKAKKDITF

YMPVDNLGMAVIDWEEWRPTWARNWKPKDVYKNRSIELVQQQNVQLSLT

EATEKAKQEFEKAGKDFLVETIKLGKLLRPNHLWGYYLFPDCYNHHYKK

PGYNGSCFNVEIKRNDDLSWLWNESTALYPSIYLNTQQSPVAATLYVRN

RVREAIRVSKIPDAKSPLPVFAYTRIVFTDQVLKFLSQDELVYTFGETV

ALGASGIVIWGTLSIMRSMKSCLLLDNYMETILNPYIINVTLAAKMCSQ

VLCQEQGVCIRKNWNSSDYLHLNPDNFAIQLEKGGKFTVRGKPTLEDLE

QFSEKFYCSCYSTLSCKEKADVKDTDAVDVCIADGVCIDAFLKPPMETE

EPQIFYNASPSTLS.
```

In any of the methods provided herein, the anti-hyaluronan agent can be an agent that degrades hyaluronan or can be an agent that inhibits the synthesis of hyaluronan. For example, the anti-hyaluronan agent can be a hyaluronan degrading enzyme. In another example, the anti-hyaluronan agent or is an agent that inhibits hyaluronan synthesis. For example, the anti-hyaluronan agent is an agent that inhibits hyaluronan synthesis such as a sense or antisense nucleic acid molecule against an HA synthase or is a small molecule drug. For example, an anti-hyaluronan agent is 4-methylumbelliferone (MU) or a derivative thereof, or leflunomide or a derivative thereof. Such derivatives include, for example, a derivative of 4-methylumbelliferone (MU) that is 6,7-dihydroxy-4-methyl coumarin or 5,7-dihydroxy-4-methyl coumarin.

In further examples of the methods provided herein, the hyaluronan degrading enzyme is a hyaluronidase. In some examples, the hyaluronan-degrading enzyme is a PH20 hyaluronidase or truncated form thereof to lacking a C-terminal glycosylphosphatidylinositol (GPI) attachment site or a portion of the GPI attachment site. In specific examples, the hyaluronidase is a PH20 selected from a human, monkey, bovine, ovine, rat, mouse or guinea pig PH20. For example, the hyaluronan-degrading enzyme is a human PH20 hyaluronidase that is neutral active and N-glycosylated and is selected from among (a) a hyaluronidase polypeptide that is a full-length PH20 or is a C-terminal truncated form of the PH20, wherein the truncated form includes at least amino acid residues 36-464 of SEQ ID NO: 7248, such as 36-481, 36-482, 36-483, where the full-length PH20 has the sequence of amino acids set forth in SEQ ID NO: 7248; or (b) a hyaluronidase polypeptide comprising a sequence of amino acids having at least 85%, 86%, 87%, 88%, 89%, 90%, 91%, 92%, 93%, 94%, 95%, 96%, 97%, 98%, 99% or more sequence identity with the polypeptide or truncated form of sequence of amino acids set forth in SEQ ID NO: 7248; or (c) a hyaluronidase polypeptide of (a) or (b) comprising amino acid substitutions, whereby the hyaluronidase polypeptide has a sequence of amino acids having at least 85%, 86%, 87%, 88%, 89%, 90%, 91%, 92%, 93%, 94%, 95%, 96%, 97%, 98%, 99% or more sequence identity with the polypeptide set forth in SEQ ID NO: 7248 or the with the corresponding truncated forms thereof. In exemplary examples, the hyaluronan-degrading enzyme is a PH20 that comprises a composition designated rHuPH20.

In other examples, the anti-hyaluronan agent is a hyaluronan degrading enzyme that is modified by conjugation to a polymer. The polymer can be a PEG and the anti-hyaluronan agent a PEGylated hyaluronan degrading enzyme. Hence, in some examples of the methods provided herein the hyaluronan-degrading enzyme is modified by conjugation to a polymer. For example, the hyaluronan-degrading enzyme is conjugated to a PEG, thus the hyaluronan degrading enzyme is PEGylated. In an exemplary example, the hyaluronan-degrading enzyme is a PEGylated PH20 enzyme (PEGPH20). In the methods provided herein, the corticosteroid can be a glucocorticoid that is selected from among cortisones, dexamethasones, hydrocortisones, methylprednisolones, prednisolones and prednisones.

Chondroitinases

Chondroitinases are enzymes found throughout the animal kingdom which degrade glycosaminoglycans, specifically chondroitins and chondroitin sulfates, through an endoglycosidase reaction. In some embodiments the chondroitinase is a mammalian chondroitinase. In some embodiments the chondroitinase is a recombinant human chondroitinase. In some embodiments the chondroitinase is HYAL4. Other exemplary chondroitinases include chondroitinase ABC (derived from *Proteus vulgaris*; Japanese Patent Application Laid-open No 6-153947, T. Yamagata et al. J. Biol. Chem., 243, 1523 (1968), S. Suzuki et al, J. Biol. Chem., 243, 1543 (1968)), chondroitinase AC (derived from *Flavobacterium heparinum*; T. Yamagata et al., J. Biol. Chem., 243, 1523 (1968)), chondroitinase AC II (derived from *Arthrobacter aurescens*; K. Hiyama, and S. Okada, J. Biol. Chem., 250, 1824 (1975), K. Hiyama and S. Okada, J. Biochem. (Tokyo), 80, 1201 (1976)), Hyaluronidase ACIII (derived from *Flavobacterium* sp. Hp102; Hirofumi Miyazono et al., Seikagaku, 61, 1023 (1989)), chondroitinase B (derived from *Flavobacterium heparinum*; Y. M. Michelacci and C. P. Dietrich, Biochem. Biophys. Res. Commun., 56, 973 (1974), Y. M. Michelacci and C. P. Dietrich, Biochem. J., 151, 121 (1975), Kenichi Maeyama et al, Seikagaku, 57, 1189 (1985)), chondroitinase C (derived from *Flavobacterium* sp. Hp102; Hirofumi Miyazono et al, Seikagaku, 61, 1023 (1939)), and the like.

Matrix Metalloproteinases

Matrix metalloproteases (MMPs) are zinc-dependent endopeptidases that are the major proteases involved in extracellular matrix (ECM) degradation. MMPs are capable of degrading a wide range of extracellular molecules and a number of bioactive molecules. Twenty-four MMP genes have been identified in humans, which can be organized into six groups based on domain organization and substrate preference: Collagenases (MMP-1, -8 and -13), Gelatinases (MMP-2 and MMP-9), Stromelysins (MMP-3, -10 and -11), Matrilysin (MMP-7 and MMP-26), Membrane-type (MT)-MMPs (MMP-14, -15, -16, -17, -24 and -25) and others (MMP-12, -19, -20, -21, -23, -27 and -28). In some embodiments, the stromal modifying moiety is a human recombinant MMP (e.g., MMP-1, -2, -3, -4, -5, -6, -7, -8, -9, 10, -11, -12, -13, -14, 15, -15, -17, -18, -19, 20, -21, -22, -23, or -24).

Collagenases

The three mammalian collagenases (MMP-1, -8, and -13) are the principal secreted endopeptidases capable of cleaving collagenous extracellular matrix. In addition to fibrillar collagens, collagenases can cleave several other matrix and non-matrix proteins including growth factors. Collagenases are synthesized as inactive pro-forms, and once activated, their activity is inhibited by specific tissue inhibitors of metalloproteinases, TIMPs, as well as by non-specific proteinase inhibitors (Ala-aho R et al. *Biochimie*. Collagenases in cancer. 2005 March-April; 87(3-4):273-86). In some embodiments, the stromal modifying moiety is a collagenase. In some embodiments, the collagenase is a human recombinant collagenase. In some embodiments, the collagenase is MMP-1. In some embodiments, the collagenase is MMP-8. In some embodiments, the collagenase is MMP-13.

Macrophage Metalloelastase

Macrophage metalloelastase (MME), also known as MMP-12, is a member of the stromelysin subgroup of MMPs and catalyzes the hydrolysis of soluble and insoluble elastin and a broad selection of matrix and nonmatrix substrates including type IV collagen, fibronectin, laminin, vitronectin, entactin, heparan, and chondroitin sulfates (Erja Kerkelä et al. Journal of Investigative Dermatology (2000) 114, 1113-1119; doi:10.1046/j.1523-1747.2000.00993). In some embodiments, the stromal modifying moiety is a MME. In some embodiments, the MME is a human recombinant MME. In some embodiments, the MME is MMP-12.

Additional Stromal Modifying Moieties

In some embodiments, the stromal modifying moiety causes one or more of: decreases the level or production of a stromal or extracellular matrix (ECM) component; decreases tumor fibrosis; increases interstitial tumor transport; improves tumor perfusion; expands the tumor microvasculature; decreases interstitial fluid pressure (IFP) in a tumor; or decreases or enhances penetration or diffusion of an agent, e.g., a cancer therapeutic or a cellular therapy, into a tumor or tumor vasculature.

In some embodiments, the stromal or ECM component decreased is chosen from a glycosaminoglycan or an extracellular protein, or a combination thereof. In some embodiments, the glycosaminoglycan is chosen from hyaluronan (also known as hyaluronic acid or HA), chondroitin sulfate, chondroitin, dermatan sulfate, heparin, heparin sulfate, entactin, tenascin, aggrecan and keratin sulfate. In some embodiments, the extracellular protein is chosen from collagen, laminin, elastin, fibrinogen, fibronectin, or vitronectin. In some embodiments, the stromal modifying moiety includes an enzyme molecule that degrades a tumor stroma or extracellular matrix (ECM). In some embodiments, the enzyme molecule is chosen from a hyaluronidase molecule, a collagenase molecule, a chondroitinase molecule, a matrix metalloproteinase molecule (e.g., macrophage metalloelastase), or a variant (e.g., a fragment) of any of the aforesaid. The term "enzyme molecule" includes a full length, a fragment or a variant of the enzyme, e.g., an enzyme variant that retains at least one functional property of the naturally occurring enzyme.

In some embodiments, the stromal modifying moiety decreases the level or production of hyaluronic acid. In other embodiments, the stromal modifying moiety comprises a hyaluronan degrading enzyme, an agent that inhibits hyaluronan synthesis, or an antibody molecule against hyaluronic acid.

In some embodiments, the hyaluronan degrading enzyme is a hyaluronidase molecule, e.g., a full length or a variant (e.g., fragment thereof) thereof. In some embodiments, the hyaluronan degrading enzyme is active in neutral or acidic pH, e.g., pH of about 4-5. In some embodiments, the hyaluronidase molecule is a mammalian hyaluronidase molecule, e.g., a recombinant human hyaluronidase molecule, e.g., a full length or a variant (e.g., fragment thereof, e.g., a truncated form) thereof. In some embodiments, the hyaluronidase molecule is chosen from HYAL1, HYAL2, or PH-20/SPAM1, or a variant thereof (e.g., a truncated form thereof). In some embodiments, the truncated form lacks a C-terminal glycosylphosphatidylinositol (GPI) attachment site or a portion of the GPI attachment site. In some embodiments, the hyaluronidase molecule is glycosylated, e.g., comprises at least one N-linked glycan.

In some embodiments, the hyaluronidase molecule comprises the amino acid sequence:

```
                                        (SEQ ID NO: 7256)
LNFRAPPVIPNVPFLWAWNAPSEFCLGKFDEPLDMSLFSFIGSPRINAT

GQGVTIFYVDRLGYYPYIDSITGVTVNGGIPQKISLQDHLDKAKKDITF

YMPVDNLGMAVIDWEEWRPTWARNWKPKDVYKNRSIELVQQQNVQLSLT

EATEKAKQEFEKAGKDFLVETIKLGKLLRPNHLWGYYLFPDCYNHHYKK

PGYNGSCFNVEIKRNDDLSWLWNESTALYPSIYLNTQQSPVAATLYVRN

RVREAIRVSKIPDAKSPLPVFAYTRIVFTDQVLKFLSQDELVYTFGETV

ALGASGIVIWGTLSIMRSMKSCLLLDNYMETILNPYIINVTLAAKMCSQ

VLCQEQGVCIRKNWNSSDYLHLNPDNFAIQLEKGGKFTVRGKPTLEDLE

QFSEKFYCSCYSTLSCKEKADVKDTDAVDVCIADGVCIDAFLKPPMETE

EPQIFYNASPSTLS,
```

or a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7256.

In some embodiments, the hyaluronidase molecule comprises:

(i) the amino acid sequence of 36-464 of SEQ ID NO: 7256;

(ii) the amino acid sequence of 36-481, 36-482, or 36-483 of PH20, wherein PH20 has the sequence of amino acids set forth in SEQ ID NO: 7256; or (iii) an amino acid sequence having at least 95% to 100% sequence identity to the polypeptide or truncated form of sequence of amino acids set forth in SEQ ID NO: 7256; or (iv) an amino acid sequence having 30, 20, 10, 5 or fewer amino acid substitutions to the amino acid sequence set forth in SEQ ID NO: 7256. In some embodiments, the hyaluronidase molecule comprises an amino acid sequence at least 95% (e.g., at least 95%, 96%, 97%, 98%, 99%, 100%) identical to the amino acid sequence of SEQ ID NO: 7256. In some embodiments, the hyaluronidase molecule is encoded by a nucleotide sequence at least 95% (e.g., at least 96%, 97%, 98%, 99%, 100%) identical to the nucleotide sequence of SEQ ID NO: 7256.

In some embodiments, the hyaluronidase molecule is PH20, e.g., rHuPH20. In some embodiments, the hyaluronidase molecule is HYAL1 and comprises the amino acid sequence:

(SEQ ID NO: 7253)
FRGPLLPNRPFTTVWNANTQWCLERHGVDVDVSVFDVVANPGQTFRGPD
MTIFYSSQGTYPYYTPTGEPVFGGLPQNASLIAHLARTFQDILAAIPAP
DFSGLAVIDWEAWRPRWAFNWDTKDIYRQRSRALVQAQHPDWPAPQVEA
VAQDQFQGAARAWMAGTLQLGRALRPRGLWGFYGFPDCYNYDFLSPNYT
GQCPSGIRAQNDQLGWLWGQSRALYPSIYMPAVLEGTGKSQMYVQHRVA
EAFRVAVAAGDPNLPVLPYVQIFYDTTNHFLPLDELEHSLGESAAQGAA
GVVLWVSWENTRTKESCQAIKEYMDTTLGPFILNVTSGALLCSQALCSG
HGRCVRRTSHPKALLLLNPASFSIQLTPGGGPLSLRGALSLEDQAQMAV
EFKCRCYPGWQAPWCERKSMW, or a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7253.

In some embodiments, the hyaluronan degrading enzyme, e.g., the hyaluronidase molecule, further comprises a polymer, e.g., is conjugated to a polymer, e.g., PEG. In some embodiments, the hyaluronan-degrading enzyme is a PEGylated PH20 enzyme (PEGPH20). In some embodiments, the hyaluronan degrading enzyme, e.g., the hyaluronidase molecule, further comprises an immunoglobulin chain constant region (e.g., Fc region) chosen from, e.g., the heavy chain constant regions of IgG1, IgG2, IgG3, and IgG4, more particularly, the heavy chain constant region of human IgG1, IgG2, IgG3, or IgG4. In some embodiments, the immunoglobulin constant region (e.g., the Fc region) is linked, e.g., covalently linked to, the hyaluronan degrading enzyme, e.g., the hyaluronidase molecule. In some embodiments, the immunoglobulin chain constant region (e.g., Fc region) is altered, e.g., mutated, to increase or decrease one or more of: Fc receptor binding, antibody glycosylation, the number of cysteine residues, effector cell function, or complement function. In some embodiments, the hyaluronan degrading enzyme, e.g., the hyaluronidase molecule forms a dimer.

In some embodiments, the stromal modifying moiety comprises an inhibitor of the synthesis of hyaluronan, e.g., an HA synthase. In some embodiments, the inhibitor comprises a sense or an antisense nucleic acid molecule against an HA synthase or is a small molecule drug. In some embodiments, the inhibitor is 4-methylumbelliferone (MU) or a derivative thereof (e.g., 6,7-dihydroxy-4-methyl coumarin or 5,7-dihydroxy-4-methyl coumarin), or leflunomide or a derivative thereof.

In some embodiments, the stromal modifying moiety comprises antibody molecule against hyaluronic acid.

In some embodiments, the stromal modifying moiety comprises a collagenase molecule, e.g., a mammalian collagenase molecule, or a variant (e.g., fragment) thereof. In some embodiments, the collagenase molecule is collagenase molecule IV, e.g., comprising the amino acid sequence of:

(SEQ ID NO: 7254)
YNFFPRKPKWDKNQITYRIIGYTPDLDPETVDDAFARAFQVWSDVTPLR
FSRIHDGEADIMINFGRWEHGDGYPFDGKDGLLAHAFAPGTGVGGDSHF
DDDELWTLGEGQVVRVKYGNADGEYCKFPFLFNGKEYNSCTDTGRSDGF

-continued
LWCSTTYNFEKDGKYGFCPHEALFTMGGNAEGQPCKFPFRFQGTSYDSC
TTEGRTDGYRWCGTTEDYDRDKKYGFCPETAMSTVGGNSEGAPCVFPFT
FLGNKYESCTSAGRSDGKMWCATTANYDDDRKWGFCPDQGYSLFLVAAH
EFGHAMGLEHSQDPGALMAPIYTYTKNFRLSQDDIKGIQELYGASPDID
LGTGPTPTLGPVTPEICKQDIVFDGIAQIRGEIFFFKDRFIWRTVTPRD
KPMGPLLVATFWPELPEKIDAVYEAPQEEKAVFFAGNEYWIYSASTLER
GYPKPLTSLGLPPDVQRVDAAFNWSKNKKTYIFAGDKFWRYNEVKKKMD
PGFPKLIADAWNAIPDNLDAVVDLQGGGHSYFFKGAYYLKLENQSLKSV
KFGSIKSDWLGC, or a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7254.

Linkers

The multispecific or multifunctional molecule disclosed herein can further include a linker, e.g., a linker between one or more of: the antigen binding domain and the cytokine molecule, the antigen binding domain and the immune cell engager, the antigen binding domain and the stromal modifying moiety, the cytokine molecule and the immune cell engager, the cytokine molecule and the stromal modifying moiety, the immune cell engager and the stromal modifying moiety, the antigen binding domain and the immunoglobulin chain constant region, the cytokine molecule and the immunoglobulin chain constant region, the immune cell engager and the immunoglobulin chain constant region, or the stromal modifying moiety and the immunoglobulin chain constant region. In embodiments, the linker is chosen from: a cleavable linker, a non-cleavable linker, a peptide linker, a flexible linker, a rigid linker, a helical linker, or a non-helical linker, or a combination thereof.

In one embodiment, the multispecific molecule can include one, two, three or four linkers, e.g., a peptide linker. In one embodiment, the peptide linker includes Gly and Ser. In some embodiments, the peptide linker is selected from GGGGS (SEQ ID NO: 7249); GGGGSGGGGS (SEQ ID NO: 7250); GGGGSGGGGSGGGGS (SEQ ID NO: 7251); and DVPSGPGGGGGSGGGGS (SEQ ID NO: 7252). In some embodiments, the peptide linker is a A(EAAAK)nA (SEQ ID NO: 7255) family of linkers (e.g., as described in Protein Eng. (2001) 14 (8): 29-532. These are stiff helical linkers with n ranging from 2-5. In some embodiments, the peptide linker is selected from (SEQ ID NO: 75)
AEAAAKEAAAKAAA;

(SEQ ID NO: 76)
AEAAAKEAAAKEAAAKAAA;

(SEQ ID NO: 77)
AEAAAKEAAAKEAAAKEAAAKAAA; and (SEQ ID NO: 78)
AEAAAKEAAAKEAAAKEAAAKEAAAKAAA.

Nucleic Acids

Nucleic acids encoding the aforementioned multispecific or multifunctional molecules are also disclosed.

In certain embodiments, the invention features nucleic acids comprising nucleotide sequences that encode heavy and light chain variable regions and CDRs or hypervariable loops of the antibody molecules, as described herein. For example, the invention features a first and second nucleic acid encoding heavy and light chain variable regions, respectively, of an antibody molecule chosen from one or more of the antibody molecules disclosed herein. The nucleic acid can comprise a nucleotide sequence as set forth in the tables herein, or a sequence substantially identical thereto (e.g., a sequence at least about 85%, 90%, 95%, 99% or more identical thereto, or which differs by no more than 3, 6, 15, 30, or 45 nucleotides from the sequences shown in the tables herein.

In certain embodiments, the nucleic acid can comprise a nucleotide sequence encoding at least one, two, or three CDRs or hypervariable loops from a heavy chain variable region having an amino acid sequence as set forth in the tables herein, or a sequence substantially homologous thereto (e.g., a sequence at least about 85%, 90%, 95%, 99% or more identical thereto, and/or having one or more substitutions, e.g., conserved substitutions). In other embodiments, the nucleic acid can comprise a nucleotide sequence encoding at least one, two, or three CDRs or hypervariable loops from a light chain variable region having an amino acid sequence as set forth in the tables herein, or a sequence substantially homologous thereto (e.g., a sequence at least about 85%, 90%, 95%, 99% or more identical thereto, and/or having one or more substitutions, e.g., conserved substitutions). In yet another embodiment, the nucleic acid can comprise a nucleotide sequence encoding at least one, two, three, four, five, or six CDRs or hypervariable loops from heavy and light chain variable regions having an amino acid sequence as set forth in the tables herein, or a sequence substantially homologous thereto (e.g., a sequence at least about 85%, 90%, 95%, 99% or more identical thereto, and/or having one or more substitutions, e.g., conserved substitutions).

In certain embodiments, the nucleic acid can comprise a nucleotide sequence encoding at least one, two, or three CDRs or hypervariable loops from a heavy chain variable region having the nucleotide sequence as set forth in the tables herein, a sequence substantially homologous thereto (e.g., a sequence at least about 85%, 90%, 95%, 99% or more identical thereto, and/or capable of hybridizing under the stringency conditions described herein). In another embodiment, the nucleic acid can comprise a nucleotide sequence encoding at least one, two, or three CDRs or hypervariable loops from a light chain variable region having the nucleotide sequence as set forth in the tables herein, or a sequence substantially homologous thereto (e.g., a sequence at least about 85%, 90%, 95%, 99% or more identical thereto, and/or capable of hybridizing under the stringency conditions described herein). In yet another embodiment, the nucleic acid can comprise a nucleotide sequence encoding at least one, two, three, four, five, or six CDRs or hypervariable loops from heavy and light chain variable regions having the nucleotide sequence as set forth in the tables herein, or a sequence substantially homologous thereto (e.g., a sequence at least about 85%, 90%, 95%, 99% or more identical thereto, and/or capable of hybridizing under the stringency conditions described herein).

In certain embodiments, the nucleic acid can comprise a nucleotide sequence encoding a cytokine molecule, an immune cell engager, or a stromal modifying moiety disclosed herein.

In another aspect, the application features host cells and vectors containing the nucleic acids described herein. The nucleic acids may be present in a single vector or separate vectors present in the same host cell or separate host cell, as described in more detail hereinbelow.

Vectors

Further provided herein are vectors comprising the nucleotide sequences encoding a multispecific or multifunctional molecule described herein. In one embodiment, the vectors comprise nucleotides encoding a multispecific or multifunctional molecule described herein. In one embodiment, the vectors comprise the nucleotide sequences described herein. The vectors include, but are not limited to, a virus, plasmid, cosmid, lambda phage or a yeast artificial chromosome (YAC).

Numerous vector systems can be employed. For example, one class of vectors utilizes DNA elements which are derived from animal viruses such as, for example, bovine papilloma virus, polyoma virus, adenovirus, vaccinia virus, baculovirus, retroviruses (Rous Sarcoma Virus, MMTV or MOMLV) or SV40 virus. Another class of vectors utilizes RNA elements derived from RNA viruses such as Semliki Forest virus, Eastern Equine Encephalitis virus and Flaviviruses.

Additionally, cells which have stably integrated the DNA into their chromosomes may be selected by introducing one or more markers which allow for the selection of transfected host cells. The marker may provide, for example, prototropy to an auxotrophic host, biocide resistance (e.g., antibiotics), or resistance to heavy metals such as copper, or the like. The selectable marker gene can be either directly linked to the DNA sequences to be expressed, or introduced into the same cell by cotransformation. Additional elements may also be needed for optimal synthesis of mRNA. These elements may include splice signals, as well as transcriptional promoters, enhancers, and termination signals.

Once the expression vector or DNA sequence containing the constructs has been prepared for expression, the expression vectors may be transfected or introduced into an appropriate host cell. Various techniques may be employed to achieve this, such as, for example, protoplast fusion, calcium phosphate precipitation, electroporation, retroviral transduction, viral transfection, gene gun, lipid based transfection or other conventional techniques. In the case of protoplast fusion, the cells are grown in media and screened for the appropriate activity. Methods and conditions for culturing the resulting transfected cells and for recovering the antibody molecule produced are known to those skilled in the art, and may be varied or optimized depending upon the specific expression vector and mammalian host cell employed, based upon the present description.

Cells

In another aspect, the application features host cells and vectors containing the nucleic acids described herein. The nucleic acids may be present in a single vector or separate vectors present in the same host cell or separate host cell. The host cell can be a eukaryotic cell, e.g., a mammalian cell, an insect cell, a yeast cell, or a prokaryotic cell, e.g., *E. coli*. For example, the mammalian cell can be a cultured cell or a cell line. Exemplary mammalian cells include lymphocytic cell lines (e.g., NSO), Chinese hamster ovary cells (CHO), COS cells, oocyte cells, and cells from a transgenic animal, e.g., mammary epithelial cell.

The invention also provides host cells comprising a nucleic acid encoding an antibody molecule as described herein.

In one embodiment, the host cells are genetically engineered to comprise nucleic acids encoding the antibody molecule.

In one embodiment, the host cells are genetically engineered by using an expression cassette. The phrase "expression cassette," refers to nucleotide sequences, which are capable of affecting expression of a gene in hosts compatible with such sequences. Such cassettes may include a promoter, an open reading frame with or without introns, and a termination signal. Additional factors necessary or helpful in effecting expression may also be used, such as, for example, an inducible promoter.

The invention also provides host cells comprising the vectors described herein.

The cell can be, but is not limited to, a eukaryotic cell, a bacterial cell, an insect cell, or a human cell. Suitable eukaryotic cells include, but are not limited to, Vero cells, HeLa cells, COS cells, CHO cells, HEK293 cells, BHK cells and MDCKII cells. Suitable insect cells include, but are not limited to, Sf9 cells.

Uses and Combination Therapies

Methods described herein include treating a cancer in a subject by using a multispecific molecule described herein, e.g., using a pharmaceutical composition described herein. Also provided are methods for reducing or ameliorating a symptom of a cancer in a subject, as well as methods for inhibiting the growth of a cancer and/or killing one or more cancer cells. In embodiments, the methods described herein decrease the size of a tumor and/or decrease the number of cancer cells in a subject administered with a described herein or a pharmaceutical composition described herein.

In embodiments, the cancer is a hematological cancer. In embodiments, the hematological cancer is a leukemia or a lymphoma. As used herein, a "hematologic cancer" refers to a tumor of the hematopoietic or lymphoid tissues, e.g., a tumor that affects blood, bone marrow, or lymph nodes. Exemplary hematologic malignancies include, but are not limited to, leukemia (e.g., acute lymphoblastic leukemia (ALL), acute myeloid leukemia (AML), chronic lymphocytic leukemia (CLL), chronic myelogenous leukemia (CML), hairy cell leukemia, acute monocytic leukemia (AMoL), chronic myelomonocytic leukemia (CMML), juvenile myelomonocytic leukemia (JMML), or large granular lymphocytic leukemia), lymphoma (e.g., AIDS-related lymphoma, cutaneous T-cell lymphoma, Hodgkin lymphoma (e.g., classical Hodgkin lymphoma or nodular lymphocyte-predominant Hodgkin lymphoma), mycosis fungoides, non-Hodgkin lymphoma (e.g., B-cell non-Hodgkin lymphoma (e.g., Burkitt lymphoma, small lymphocytic lymphoma (CLL/SLL), diffuse large B-cell lymphoma, follicular lymphoma, immunoblastic large cell lymphoma, precursor B-lymphoblastic lymphoma, or mantle cell lymphoma) or T-cell non-Hodgkin lymphoma (mycosis fungoides, anaplastic large cell lymphoma, or precursor T-lymphoblastic lymphoma)), primary central nervous system lymphoma, Sézary syndrome, Waldenström macroglobulinemia), chronic myeloproliferative neoplasm, Langerhans cell histiocytosis, multiple myeloma/plasma cell neoplasm, myelodysplastic syndrome, or myelodysplastic/myeloproliferative neoplasm.

In embodiments, the cancer is a solid cancer. Exemplary solid cancers include, but are not limited to, ovarian cancer, rectal cancer, stomach cancer, testicular cancer, cancer of the anal region, uterine cancer, colon cancer, rectal cancer, renal-cell carcinoma, liver cancer, non-small cell carcinoma of the lung, cancer of the small intestine, cancer of the esophagus, melanoma, Kaposi's sarcoma, cancer of the endocrine system, cancer of the thyroid gland, cancer of the parathyroid gland, cancer of the adrenal gland, bone cancer, pancreatic cancer, skin cancer, cancer of the head or neck, cutaneous or intraocular malignant melanoma, uterine cancer, brain stem glioma, pituitary adenoma, epidermoid cancer, carcinoma of the cervix squamous cell cancer, carcinoma of the fallopian tubes, carcinoma of the endometrium, carcinoma of the vagina, sarcoma of soft tissue, cancer of the urethra, carcinoma of the vulva, cancer of the penis, cancer of the bladder, cancer of the kidney or ureter, carcinoma of the renal pelvis, spinal axis tumor, neoplasm of the central nervous system (CNS), primary CNS lymphoma, tumor angiogenesis, metastatic lesions of said cancers, or combinations thereof.

In certain embodiments, the cancer is an epithelial, mesenchymal or hematologic malignancy. In certain embodiments, the cancer treated is a solid tumor (e.g., carcinoid, carcinoma or sarcoma), a soft tissue tumor (e.g., a heme malignancy), and a metastatic lesion, e.g., a metastatic lesion of any of the cancers disclosed herein. In one embodiment, the cancer treated is a fibrotic or desmoplastic solid tumor, e.g., a tumor having one or more of limited tumor perfusion, compressed blood vessels, fibrotic tumor interstitium, or increased interstitial fluid pressure. In one embodiment, the solid tumor is chosen from one or more of pancreatic (e.g., pancreatic adenocarcinoma or pancreatic ductal adenocarcinoma), breast, colon, colorectal, lung (e.g., small cell lung cancer (SCLC) or non-small cell lung cancer (NSCLC)), skin, ovarian, liver cancer, esophageal cancer, endometrial cancer, gastric cancer, head and neck cancer, kidney, or prostate cancer.

Examples of cancer include, but are not limited to, carcinoma, lymphoma, blastoma, sarcoma, and leukemia or lymphoid malignancies. More particular examples of such cancers are noted below and include: squamous cell cancer (e.g. epithelial squamous cell cancer), lung cancer including small-cell lung cancer, non-small cell lung cancer, adenocarcinoma of the lung and squamous carcinoma of the lung, cancer of the peritoneum, hepatocellular cancer, gastric or stomach cancer including gastrointestinal cancer, pancreatic cancer, glioblastoma, cervical cancer, ovarian cancer, liver cancer, bladder cancer, hepatoma, breast cancer, colon cancer, rectal cancer, colorectal cancer, endometrial cancer or uterine carcinoma, salivary gland carcinoma, kidney or renal cancer, prostate cancer, vulval cancer, thyroid cancer, hepatic carcinoma, anal carcinoma, penile carcinoma, as well as head and neck cancer. The term "cancer" includes primary malignant cells or tumors (e.g., those whose cells have not migrated to sites in the subject's body other than the site of the original malignancy or tumor) and secondary malignant cells or tumors (e.g., those arising from metastasis, the migration of malignant cells or tumor cells to secondary sites that are different from the site of the original tumor).

Other examples of cancers or malignancies include, but are not limited to: Acute Childhood Lymphoblastic Leukemia, Acute Lymphoblastic Leukemia, Acute Lymphocytic Leukemia, Acute Myeloid Leukemia, Adrenocortical Carcinoma, Adult (Primary) Hepatocellular Cancer, Adult (Primary) Liver Cancer, Adult Acute Lymphocytic Leukemia, Adult Acute Myeloid Leukemia, Adult Hodgkin's Disease, Adult Hodgkin's Lymphoma, Adult Lymphocytic Leukemia, Adult Non-Hodgkin's Lymphoma, Adult Primary Liver Cancer, Adult Soft Tissue Sarcoma, AIDS-Related Lymphoma, AIDS-Related Malignancies, Anal Cancer, Astrocytoma, Bile Duct Cancer, Bladder Cancer, Bone Cancer, Brain Stem Glioma, Brain Tumors, Breast Cancer, Cancer of the Renal Pelvis and Ureter, Central Nervous System (Primary) Lymphoma, Central Nervous System Lymphoma, Cerebellar Astrocytoma, Cerebral Astrocytoma, Cervical Cancer, Childhood (Primary) Hepatocellular Cancer, Childhood (Primary) Liver Cancer, Childhood Acute Lymphoblastic Leukemia, Childhood Acute Myeloid Leukemia, Childhood Brain Stem Glioma, Childhood Cerebellar Astrocytoma, Childhood Cerebral Astrocytoma, Childhood Extracranial Germ Cell Tumors, Childhood Hodgkin's Disease, Childhood Hodgkin's Lymphoma, Childhood Hypothalamic and Visual Pathway Glioma, Childhood Lymphoblastic Leukemia, Childhood Medulloblastoma, Childhood Non-Hodgkin's Lymphoma, Childhood Pineal and Supratentorial Primitive Neuroectodermal Tumors, Childhood Primary Liver Cancer, Childhood Rhabdomyosarcoma, Childhood Soft Tissue Sarcoma, Childhood Visual Pathway and Hypothalamic Glioma, Chronic Lymphocytic Leukemia, Chronic Myelogenous Leukemia, Colon Cancer, Cutaneous T-Cell Lymphoma, Endocrine Pancreas Islet Cell Carcinoma, Endometrial Cancer, Ependymoma, Epithelial Cancer, Esophageal Cancer, Ewing's Sarcoma and Related Tumors, Exocrine Pancreatic Cancer, Extracranial Germ Cell Tumor, Extragonadal Germ Cell Tumor, Extrahepatic Bile Duct Cancer, Eye Cancer, Female Breast Cancer, Gaucher's Disease, Gallbladder Cancer, Gastric Cancer, Gastrointestinal Carcinoid Tumor, Gastrointestinal Tumors, Germ Cell Tumors, Gestational Trophoblastic Tumor, Hairy Cell Leukemia, Head and Neck Cancer, Hepatocellular Cancer, Hodgkin's Disease, Hodgkin's Lymphoma, Hypergammaglobulinemia, Hypopharyngeal Cancer, Intestinal Cancers, Intraocular Melanoma, Islet Cell Carcinoma, Islet Cell Pancreatic Cancer, Kaposi's Sarcoma, Kidney Cancer, Laryngeal Cancer, Lip and Oral Cavity Cancer, Liver Cancer, Lung Cancer, Lymphoproliferative Disorders, Macroglobulinemia, Male Breast Cancer, Malignant Mesothelioma, Malignant Thymoma, Medulloblastoma, Melanoma, Mesothelioma, Metastatic Occult Primary Squamous Neck Cancer, Metastatic Primary Squamous Neck Cancer, Metastatic Squamous Neck Cancer, Multiple Myeloma, Multiple Myeloma/Plasma Cell Neoplasm, Myelodysplastic Syndrome, Myelogenous Leukemia, Myeloid Leukemia, Myeloproliferative Disorders, Nasal Cavity and Paranasal Sinus Cancer, Nasopharyngeal Cancer, Neuroblastoma, Non-Hodgkin's Lymphoma During Pregnancy, Nonmelanoma Skin Cancer, Non-Small Cell Lung Cancer, Occult Primary Metastatic Squamous Neck Cancer, Oropharyngeal Cancer, Osteo-/Malignant Fibrous Sarcoma, Osteosarcoma/Malignant Fibrous Histiocytoma, Osteosarcoma/Malignant Fibrous Histiocytoma of Bone, Ovarian Epithelial Cancer, Ovarian Germ Cell Tumor, Ovarian Low Malignant Potential Tumor, Pancreatic Cancer, Paraproteinemias, Purpura, Parathyroid Cancer, Penile Cancer, Pheochromocytoma, Pituitary Tumor, Plasma Cell Neoplasm/Multiple Myeloma, Primary Central Nervous System Lymphoma, Primary Liver Cancer, Prostate Cancer, Rectal Cancer, Renal Cell Cancer, Renal Pelvis and Ureter Cancer, Retinoblastoma, Rhabdomyosarcoma, Salivary Gland Cancer, Sarcoidosis Sarcomas, Sezary Syndrome, Skin Cancer, Small Cell Lung Cancer, Small Intestine Cancer, Soft Tissue Sarcoma, Squamous Neck Cancer, Stomach Cancer, Supratentorial Primitive Neuroectodermal and Pineal Tumors, T-Cell Lymphoma, Testicular Cancer, Thymoma, Thyroid Cancer, Transitional Cell Cancer of the Renal Pelvis and Ureter, Transitional Renal Pelvis and Ureter Cancer, Trophoblastic Tumors, Ureter and Renal Pelvis Cell Cancer, Urethral Cancer, Uterine Cancer, Uterine Sarcoma, Vaginal Cancer, Visual Pathway and Hypothalamic Glioma, Vulvar Cancer, Waldenstrom's Macroglobulinemia, Wilms' Tumor, and any other hyperproliferative disease, besides neoplasia, located in an organ system listed above.

In other embodiments, the multispecific molecule, as described above and herein, is used to treat a hyperproliferative disorder, e.g., a hyperproliferative connective tissue disorder (e.g., a hyperproliferative fibrotic disease). In one embodiment, the hyperproliferative fibrotic disease is multisystemic or organ-specific. Exemplary hyperproliferative fibrotic diseases include, but are not limited to, multisystemic (e.g., systemic sclerosis, multifocal fibrosclerosis, sclerodermatous graft-versus-host disease in bone marrow transplant recipients, nephrogenic systemic fibrosis, scleroderma), and organ-specific disorders (e.g., fibrosis of the eye, lung, liver, heart, kidney, pancreas, skin and other organs). In other embodiments, the disorder is chosen from liver cirrhosis or tuberculosis. In other embodiments, the disorder is leprosy.

In embodiments, the multispecific molecules (or pharmaceutical composition) are administered in a manner appropriate to the disease to be treated or prevented. The quantity and frequency of administration will be determined by such factors as the condition of the patient, and the type and severity of the patient's disease. Appropriate dosages may be determined by clinical trials. For example, when "an effective amount" or "a therapeutic amount" is indicated, the precise amount of the pharmaceutical composition (or multispecific molecules) to be administered can be determined by a physician with consideration of individual differences in tumor size, extent of infection or metastasis, age, weight, and condition of the subject. In embodiments, the pharmaceutical composition described herein can be administered at a dosage of $10^4$ to $10^9$ cells/kg body weight, e.g., $10^5$ to $10^6$ cells/kg body weight, including all integer values within those ranges. In embodiments, the pharmaceutical composition described herein can be administered multiple times at these dosages. In embodiments, the pharmaceutical composition described herein can be administered using infusion techniques described in immunotherapy (see, e.g., Rosenberg et al., New Eng. J. of Med. 319:1676, 1988).

In embodiments, the cancer is a myeloproliferative neoplasm, e.g., primary or idiopathic myelofibrosis (MF), essential thrombocytosis (ET), polycythemia vera (PV), or chronic myelogenous leukemia (CML). In embodiments, the cancer is myelofibrosis. In embodiments, the subject has myelofibrosis. In embodiments, the subject has a calreticulin mutation, e.g., a calreticulin mutation disclosed herein. In embodiments, the subject does not have the JAK2-V617F mutation. In embodiments, the subject has the JAK2-V617F mutation. In embodiments, the subject has a MPL mutation. In embodiments, the subject does not have a MPL mutation.

In embodiments, the cancer is a solid cancer. Exemplary solid cancers include, but are not limited to, ovarian cancer, rectal cancer, stomach cancer, testicular cancer, cancer of the anal region, uterine cancer, colon cancer, rectal cancer, renal-cell carcinoma, liver cancer, non-small cell carcinoma of the lung, cancer of the small intestine, cancer of the esophagus, melanoma, Kaposi's sarcoma, cancer of the endocrine system, cancer of the thyroid gland, cancer of the parathyroid gland, cancer of the adrenal gland, bone cancer, pancreatic cancer, skin cancer, cancer of the head or neck, cutaneous or intraocular malignant melanoma, uterine cancer, brain stem glioma, pituitary adenoma, epidermoid cancer, carcinoma of the cervix squamous cell cancer, carcinoma of the fallopian tubes, carcinoma of the endometrium, carcinoma of the vagina, sarcoma of soft tissue, cancer of the urethra, carcinoma of the vulva, cancer of the penis, cancer of the bladder, cancer of the kidney or ureter, carcinoma of the renal pelvis, spinal axis tumor, neoplasm of the central nervous system (CNS), primary CNS lymphoma, tumor angiogenesis, metastatic lesions of said cancers, or combinations thereof.

In embodiments, the multispecific molecules or pharmaceutical composition is administered to the subject parenterally. In embodiments, the cells are administered to the subject intravenously, subcutaneously, intratumorally, intranodally, intramuscularly, intradermally, or intraperitoneally. In embodiments, the cells are administered, e.g., injected, directly into a tumor or lymph node. In embodiments, the cells are administered as an infusion (e.g., as described in Rosenberg et al., New Eng. J. of Med. 319: 1676, 1988) or an intravenous push. In embodiments, the cells are administered as an injectable depot formulation.

In embodiments, the subject is a mammal. In embodiments, the subject is a human, monkey, pig, dog, cat, cow, sheep, goat, rabbit, rat, or mouse. In embodiments, the subject is a human. In embodiments, the subject is a pediatric subject, e.g., less than 18 years of age, e.g., less than 17, 16, 15, 14, 13, 12, 11, 10, 9, 8, 7, 6, 5, 4, 3, 2, 1 or less years of age. In embodiments, the subject is an adult, e.g., at least 18 years of age, e.g., at least 19, 20, 21, 22, 23, 24, 25, 25-30, 30-35, 35-40, 40-50, 50-60, 60-70, 70-80, or 80-90 years of age.

Combination Therapies

The multispecific or multifunctional molecules disclosed herein can be used in combination with a second therapeutic agent or procedure.

In embodiments, the multispecific or multifunctional molecule and the second therapeutic agent or procedure are administered/performed after a subject has been diagnosed with a cancer, e.g., before the cancer has been eliminated from the subject. In embodiments, the multispecific or multifunctional molecule and the second therapeutic agent or procedure are administered/performed simultaneously or concurrently. For example, the delivery of one treatment is still occurring when the delivery of the second commences, e.g., there is an overlap in administration of the treatments. In other embodiments, the multispecific or multifunctional molecule and the second therapeutic agent or procedure are administered/performed sequentially. For example, the delivery of one treatment ceases before the delivery of the other treatment begins.

In embodiments, combination therapy can lead to more effective treatment than monotherapy with either agent alone. In embodiments, the combination of the first and second treatment is more effective (e.g., leads to a greater reduction in symptoms and/or cancer cells) than the first or second treatment alone. In embodiments, the combination therapy permits use of a lower dose of the first or the second treatment compared to the dose of the first or second treatment normally required to achieve similar effects when administered as a monotherapy. In embodiments, the combination therapy has a partially additive effect, wholly additive effect, or greater than additive effect.

In one embodiment, the multispecific or multifunctional molecule is administered in combination with a therapy, e.g., a cancer therapy (e.g., one or more of anti-cancer agents, immunotherapy, photodynamic therapy (PDT), surgery and/or radiation). The terms "chemotherapeutic," "chemotherapeutic agent," and "anti-cancer agent" are used interchangeably herein. The administration of the multispecific or multifunctional molecule and the therapy, e.g., the cancer therapy, can be sequential (with or without overlap) or simultaneous. Administration of the multispecific or multifunctional molecule can be continuous or intermittent during the course of therapy (e.g., cancer therapy). Certain therapies described herein can be used to treat cancers and non-cancerous diseases. For example, PDT efficacy can be enhanced in cancerous and non-cancerous conditions (e.g., tuberculosis) using the methods and compositions described herein (reviewed in, e.g., Agostinis, P. et al. (2011) *CA Cancer J. Clin.* 61:250-281).

Anti-Cancer Therapies

In other embodiments, the multispecific or multifunctional molecule is administered in combination with a low or small molecular weight chemotherapeutic agent. Exemplary low or small molecular weight chemotherapeutic agents include, but not limited to, 13-cis-retinoic acid (isotretinoin, ACCUTANE®), 2-CdA (2-chlorodeoxyadenosine, cladribine, LEUSTATIN™), 5-azacitidine (azacitidine, VIDAZA®), 5-fluorouracil (5-FU, fluorouracil, ADRUCIL®), 6-mercaptopurine (6-MP, mercaptopurine, PURINETHOL®), 6-TG (6-thioguanine, thioguanine, THIOGUANINE TABLOID®), abraxane (paclitaxel protein-bound), actinomycin-D (dactinomycin, COSMEGEN®), alitretinoin (PANRETIN®), all-transretinoic acid (ATRA, tretinoin, VESANOID®), altretamine (hexamethylmelamine, HMM, HEXALEN®), amethopterin (methotrexate, methotrexate sodium, MTX, TREXALL™, RHEUMATREX®), amifostine (ETHYOL®), arabinosylcytosine (Ara-C, cytarabine, CYTOSAR-U®), arsenic trioxide (TRISENOX®), asparaginase (Erwinia L-asparaginase, L-asparaginase, ELSPAR®, KIDROLASE®), BCNU (carmustine, BiCNU®), bendamustine (TREANDA®), bexarotene (TARGRETIN®), bleomycin (BLENOXANE®), busulfan (BUSULFEX®, MYLERAN®), calcium leucovorin (Citrovorum Factor, folinic acid, leucovorin), camptothecin-11 (CPT-11, irinotecan, CAMPTOSAR®), capecitabine (XELODA®), carboplatin (PARAPLATIN®), carmustine wafer (prolifeprospan 20 with carmustine implant, GLIADEL® wafer), CCI-779 (temsirolimus, TORISEL®), CCNU (lomustine, CeeNU), CDDP (cisplatin, PLATINOL®, PLATINOL-AQ®), chlorambucil (leukeran), cyclophosphamide (CYTOXAN®, NEOSAR®), dacarbazine (DIC, DTIC, imidazole carboxamide, DTIC-DOME®), daunomycin (daunorubicin, daunorubicin hydrochloride, rubidomycin hydrochloride, CERUBIDINE®), decitabine (DACOGEN®), dexrazoxane (ZINECARD®), DHAD (mitoxantrone, NOVANTRONE®), docetaxel (TAXOTERE®), doxorubicin (ADRIAMYCIN®, RUBEX®), epirubicin (ELLENCE™), estramustine (EMCYT®), etoposide (VP-16, etoposide phosphate, TOPOSAR®, VEPESID®, ETOPOPHOS®), floxuridine (FUDR®), fludarabine (FLUDARA®), fluorouracil (cream) (CARAC™, EFUDEX®, FLUOROPLEX®), gemcitabine (GEMZAR®), hydroxyurea (HYDREA®, DROXIA™, MYLOCEL™) idarubicin (IDAMYCIN®), ifosfamide (IFEX®), ixabepilone (IXEMPRA™), LCR (leurocristine, vincristine, VCR, ONCOVIN®, VINCASAR PFS®), L-PAM (L-sarcolysin, melphalan, phenylalanine mustard, ALKERAN®), mechlorethamine (mechlorethamine hydrochloride, mustine, nitrogen mustard, MUSTARGEN®), mesna (MESNEX™), mitomycin (mitomycin-C, MTC, MUTAMYCIN®), nelarabine (ARRANON®), oxaliplatin (ELOXATIN™), paclitaxel (TAXOL®, ONXAL™), pegaspargase (PEG-L-asparaginase, ONCOSPAR®), PEMETREXED (ALIMTA®), pentostatin (NIPENT®), procarbazine (MATULANE®), streptozocin (ZANOSAR®), temozolomide (TEMO- DAR®), teniposide (VM-26, VUMON®), TESPA (thiophosphoamide, thiotepa, TSPA, THIOPLEX®), topotecan (HYCAMTIN®), vinblastine (vinblastine sulfate, vincaleukoblastine, VLB, ALKABAN-AQ®, VELBAN®), vinorelbine (vinorelbine tartrate, NAVELBINE®), and vorinostat (ZOLINZA®).

In another embodiment, the multispecific or multifunctional molecule is administered in conjunction with a biologic. Biologics useful in the treatment of cancers are known in the art and a binding molecule of the invention may be administered, for example, in conjunction with such known biologics. For example, the FDA has approved the following biologics for the treatment of breast cancer: HERCEPTIN® (trastuzumab, Genentech Inc., South San Francisco, Calif; a humanized monoclonal antibody that has anti-tumor activity in HER2-positive breast cancer); FASLODEX® (fulvestrant, AstraZeneca Pharmaceuticals, LP, Wilmington, Del.; an estrogen-receptor antagonist used to treat breast cancer); ARIMIDEX® (anastrozole, AstraZeneca Pharmaceuticals, LP; a nonsteroidal aromatase inhibitor which blocks aromatase, an enzyme needed to make estrogen); Aromasin® (exemestane, Pfizer Inc., New York, N.Y.; an irreversible, steroidal aromatase inactivator used in the treatment of breast cancer); FEMARA® (letrozole, Novartis Pharmaceuticals, East Hanover, N.J.; a nonsteroidal aromatase inhibitor approved by the FDA to treat breast cancer); and NOLVADEX® (tamoxifen, AstraZeneca Pharmaceuticals, LP; a nonsteroidal antiestrogen approved by the FDA to treat breast cancer). Other biologics with which the binding molecules of the invention may be combined include: AVASTIN® (bevacizumab, Genentech Inc.; the first FDA-approved therapy designed to inhibit angiogenesis); and ZEVALIN® (ibritumomab tiuxetan, Biogen Idec, Cambridge, Mass.; a radiolabeled monoclonal antibody currently approved for the treatment of B-cell lymphomas).

In addition, the FDA has approved the following biologics for the treatment of colorectal cancer: AVASTIN®; ERBITUX® (cetuximab, ImClone Systems Inc., New York, N.Y., and Bristol-Myers Squibb, New York, N.Y.; is a monoclonal antibody directed against the epidermal growth factor receptor (EGFR)); GLEEVEC® (imatinib mesylate; a protein kinase inhibitor); and ERGAMISOL® (levamisole hydrochloride, Janssen Pharmaceutica Products, LP, Titusville, N.J.; an immunomodulator approved by the FDA in 1990 as an adjuvant treatment in combination with 5-fluorouracil after surgical resection in patients with Dukes' Stage C colon cancer).

For the treatment of lung cancer, exemplary biologics include TARCEVA® (erlotinib HCL, OSI Pharmaceuticals Inc., Melville, N.Y.; a small molecule designed to target the human epidermal growth factor receptor 1 (HER1) pathway).

For the treatment of multiple myeloma, exemplary biologics include VELCADE® Velcade (bortezomib, Millennium Pharmaceuticals, Cambridge Mass.; a proteasome inhibitor). Additional biologics include THALIDOMID® (thalidomide, Clegene Corporation, Warren, N.J.; an immunomodulatory agent and appears to have multiple actions, including the ability to inhibit the growth and survival of myeloma cells and anti-angiogenesis).

Additional exemplary cancer therapeutic antibodies include, but are not limited to, 3F8, abagovomab, adecatumumab, afutuzumab, alacizumab pegol, alemtuzumab (CAMPATH®, MABCAMPATH®), altumomab pentetate (HYBRI-CEAKER®), anatumomab mafenatox, anrukinzumab (IMA-638), apolizumab, arcitumomab (CEA-SCAN®), bavituximab, bectumomab (LYMPHOSCAN®), belimumab (BENLYSTA®, LYMPHOSTAT-B®), besilesomab (SCINTIMUN®), bevacizumab (AVASTIN®), bivatuzumab mertansine, blinatumomab, brentuximab vedotin, cantuzumab mertansine, capromab pendetide (PROSTASCINT®), catumaxomab (REMOVAB®), CC49, cetuximab (C225, ERBITUX®), citatuzumab bogatox, cixutumumab, clivatuzumab tetraxetan, conatumumab, dacetuzumab, denosumab (PROLIA®), detumomab, ecromeximab, edrecolomab (PANOREX®), elotuzumab, epitumomab cit判uxetan, epratuzumab, ertumaxomab (REXOMUN®), etaracizumab, farletuzumab, figitumumab, fresolimumab, galiximab, gemtuzumab ozogamicin (MYLOTARG®), girentuximab, glembatumumab vedotin, ibritumomab (ibritumomab tiuxetan, ZEVALIN®), igovomab (INDIMACIS-125®), intetumumab, inotuzumab ozogamicin, ipilimumab, iratumumab, labetuzumab (CEA-CIDE®), lexatumumab, lintuzumab, lucatumumab, lumiliximab, mapatumumab, matuzumab, milatuzumab, minretumomab, mitumomab, nacolomab tafenatox, naptumomab estafenatox, necitumumab, nimotuzumab (THERACIM®, THERALOC®), nofetumomab merpentan (VERLUMA®), ofatumumab (ARZERRA®), olaratumab, oportuzumab monatox, oregovomab (OVAREX®), panitumumab (VECTIBIX®), pemtumomab (THERAGYN®), pertuzumab (OMNITARG®), pintumomab, pritumumab, ramucirumab, ranibizumab (LUCENTIS®), rilotumumab, rituximab (MABTHERA®, RITUXAN®), robatumumab, satumomab pendetide, sibrotuzumab, siltuximab, sontuzumab, tacatuzumab tetraxetan (AFP-CIDE®), taplitumomab paptox, tenatumomab, TGN1412, ticilimumab (tremelimumab), tigatuzumab, TNX-650, tositumomab (BEXXAR®), trastuzumab (HERCEPTIN®), tremelimumab, tucotuzumab celmoleukin, veltuzumab, volociximab, votumumab (HUMASPECT®), zalutumumab (HUMAX-EGFR®), and zanolimumab (HUMAX-CD4®).

In other embodiments, the multispecific or multifunctional molecule is administered in combination with a viral cancer therapeutic agent. Exemplary viral cancer therapeutic agents include, but not limited to, vaccinia virus (vvDD-CDSR), carcinoembryonic antigen-expressing measles virus, recombinant vaccinia virus (TK-deletion plus GM-CSF), Seneca Valley virus-001, Newcastle virus, coxsackie virus A21, GL-ONC1, EBNA1 C-terminal/LMP2 chimeric protein-expressing recombinant modified vaccinia Ankara vaccine, carcinoembryonic antigen-expressing measles virus, G207 oncolytic virus, modified vaccinia virus Ankara vaccine expressing p53, OncoVEX GM-CSF modified herpes-simplex 1 virus, fowlpox virus vaccine vector, recombinant vaccinia prostate-specific antigen vaccine, human papillomavirus 16/18 L1 virus-like particle/AS04 vaccine, MVA-EBNA1/LMP2 Inj. vaccine, quadrivalent HPV vaccine, quadrivalent human papillomavirus (types 6, 11, 16, 18) recombinant vaccine (GARDASIL®), recombinant fowlpox-CEA(6D)/TRICOM vaccine; recombinant vaccinia-CEA(6D)-TRICOM vaccine, recombinant modified vaccinia Ankara-5T4 vaccine, recombinant fowlpox-TRICOM vaccine, oncolytic herpes virus NV1020, HPV L1 VLP vaccine V504, human papillomavirus bivalent (types 16 and 18) vaccine (CERVARIX®), herpes simplex virus HF10, Ad5CMV-p53 gene, recombinant vaccinia DF3/MUC1 vaccine, recombinant vaccinia-MUC-1 vaccine, recombinant vaccinia-TRICOM vaccine, ALVAC MART-1 vaccine, replication-defective herpes simplex virus type I (HSV-1) vector expressing human Preproenkephalin (NP2), wild-type reovirus, reovirus type 3 Dearing (REOLYSIN®), oncolytic virus HSV1716, recombinant modified vaccinia Ankara (MVA)-based vaccine encoding Epstein-Barr virus target antigens, recombinant fowlpox-prostate specific antigen vaccine, recombinant vaccinia prostate-specific antigen vaccine, recombinant vaccinia-B7.1 vaccine, rAd-p53 gene, Ad5-delta24RGD, HPV vaccine 580299, JX-594 (thymidine kinase-deleted vaccinia virus plus GM-CSF), HPV-16/18 L1/AS04, fowlpox virus vaccine vector, vaccinia-tyrosinase vaccine, MEDI-517 HPV-16/18 VLP AS04 vaccine, adenoviral vector containing the thymidine kinase of herpes simplex virus TK99UN, HspE7, FP253/Fludarabine, ALVAC(2) melanoma multi-antigen therapeutic vaccine, ALVAC-hB7.1, canarypox-hIL-12 melanoma vaccine, Ad-REIC/Dkk-3, rAd-IFN SCH 721015, TIL-Ad-INFg, Ad-ISF35, and coxsackievirus A21 (CVA21, CAVATAK®).

In other embodiments, the multispecific or multifunctional molecule is administered in combination with a nanopharmaceutical. Exemplary cancer nanopharmaceuticals include, but not limited to, ABRAXANE® (paclitaxel bound albumin nanoparticles), CRLX101 (CPT conjugated to a linear cyclodextrin-based polymer), CRLX288 (conjugating docetaxel to the biodegradable polymer poly (lactic-co-glycolic acid)), cytarabine liposomal (liposomal Ara-C, DEPOCYT™), daunorubicin liposomal (DAUNOXOME®), doxorubicin liposomal (DOXIL®, CAELYX®), encapsulated-daunorubicin citrate liposome (DAUNOXOME®), and PEG anti-VEGF aptamer (MACUGEN®).

In some embodiments, the multispecific or multifunctional molecule is administered in combination with paclitaxel or a paclitaxel formulation, e.g., TAXOL®, protein-bound paclitaxel (e.g., ABRAXANE®). Exemplary paclitaxel formulations include, but are not limited to, nanoparticle albumin-bound paclitaxel (ABRAXANE®, marketed by Abraxis Bioscience), docosahexaenoic acid bound-paclitaxel (DHA-paclitaxel, Taxoprexin, marketed by Protarga), polyglutamate bound-paclitaxel (PG-paclitaxel, paclitaxel poliglumex, CT-2103, XYOTAX, marketed by Cell Therapeutic), the tumor-activated prodrug (TAP), ANG105 (Angiopep-2 bound to three molecules of paclitaxel, marketed by ImmunoGen), paclitaxel-EC-1 (paclitaxel bound to the erbB2-recognizing peptide EC-1; see Li et al., *Biopolymers* (2007) 87:225-230), and glucose-conjugated paclitaxel (e.g., 2'-paclitaxel methyl 2-glucopyranosyl succinate, see Liu et al., *Bioorganic & Medicinal Chemistry Letters* (2007) 17:617-620).

Exemplary RNAi and antisense RNA agents for treating cancer include, but not limited to, CALAA-01, siG12D LODER (Local Drug EluteR), and ALN-VSP02.

Other cancer therapeutic agents include, but not limited to, cytokines (e.g., aldesleukin (IL-2, Interleukin-2, PROLEUKIN®), alpha Interferon (IFN-alpha, Interferon alfa, INTRON® A (Interferon alfa-2b), ROFERON-A® (Interferon alfa-2a)), Epoetin alfa (PROCRIT®), filgrastim (G-CSF, Granulocyte-Colony Stimulating Factor, NEUPOGEN®), GM-CSF (Granulocyte Macrophage Colony Stimulating Factor, sargramostim, LEUKINE™), IL-11 (Interleukin-11, oprelvekin, NEUMEGA®), Interferon alfa-2b (PEG conjugate) (PEG interferon, PEG-INTRON™), and pegfilgrastim (NEULASTA™)), hormone therapy agents (e.g., aminoglutethimide (CYTADREN®), anastrozole (ARIMIDEX®), bicalutamide (CASODEX®), exemestane (AROMASIN®), fluoxymesterone (HALOTESTIN®), flutamide (EULEXIN®), fulvestrant (FASLODEX®), goserelin (ZOLADEX®), letrozole (FEMARA®), leuprolide (ELIGARD™, LUPRON®, LUPRON DEPOT®, VIADUR™), megestrol (megestrol acetate, MEGACE®), nilutamide (ANANDRON®, NILANDRON®), octreotide (octreotide acetate, SANDOSTATIN®, SANDOSTATIN LAR®), raloxifene (EVISTA®), romiplostim (NPLATE®), tamoxifen (NOVALDEX®), and toremifene (FARESTON®)), phospholipase A2 inhibitors (e.g., anagrelide (AGRYLIN®)), biologic response modifiers (e.g., BCG (THERACYS®, TICE®), and Darbepoetin alfa (ARANESP®)), target therapy agents (e.g., bortezomib (VELCADE®), dasatinib (SPRYCEL™), denileukin diftitox (ONTAK®), erlotinib (TARCEVA®), everolimus (AFINITOR®), gefitinib (IRESSA®), imatinib mesylate (STI-571, GLEEVEC™), lapatinib (TYKERB®), sorafenib (NEXAVAR®), and SU11248 (sunitinib, SUTENT®)), immunomodulatory and antiangiogenic agents (e.g., CC-5013 (lenalidomide, REVLIMID®), and thalidomide (THALOMID®)), glucocorticosteroids (e.g., cortisone (hydrocortisone, hydrocortisone sodium phosphate, hydrocortisone sodium succinate, ALA-CORT®, HYDROCORT ACETATE®, hydrocortone phosphate LANACORT®, SOLU-CORTEF®), decadron (dexamethasone, dexamethasone acetate, dexamethasone sodium phosphate, DEXASONE®, DIODEX®, HEXADROL®, MAXIDEX®), methylprednisolone (6-methylprednisolone, methylprednisolone acetate, methylprednisolone sodium succinate, DURALONE®, MEDRALONE®, MEDROL®, M-PREDNISOL®, SOLU-MEDROL®), prednisolone (DELTA-CORTEF®, ORAPRED®, PEDIAPRED®, PRELONE®), and prednisone (DELTASONE®, LIQUID PRED®, METICORTEN®, ORASONE®)), and bisphosphonates (e.g., pamidronate (AREDIA®), and zoledronic acid (ZOMETA®))

In some embodiments, the multispecific or multifunctional molecule is used in combination with a tyrosine kinase inhibitor (e.g., a receptor tyrosine kinase (RTK) inhibitor). Exemplary tyrosine kinase inhibitor include, but are not limited to, an epidermal growth factor (EGF) pathway inhibitor (e.g., an epidermal growth factor receptor (EGFR) inhibitor), a vascular endothelial growth factor (VEGF) pathway inhibitor (e.g., an antibody against VEGF, a VEGF trap, a vascular endothelial growth factor receptor (VEGFR) inhibitor (e.g., a VEGFR-1 inhibitor, a VEGFR-2 inhibitor, a VEGFR-3 inhibitor)), a platelet derived growth factor (PDGF) pathway inhibitor (e.g., a platelet derived growth factor receptor (PDGFR) inhibitor (e.g., a PDGFR-ß inhibitor)), a RAF-1 inhibitor, a KIT inhibitor and a RET inhibitor. In some embodiments, the anti-cancer agent used in combination with the AHCM agent is selected from the group consisting of: axitinib (AG013736), bosutinib (SKI-606), cediranib (RECENTIN™, AZD2171), dasatinib (SPRYCEL®, BMS-354825), erlotinib (TARCEVA®), gefitinib (IRESSA®), imatinib (Gleevec®, CGP57148B, STI-571), lapatinib (TYKERB®, TYVERB®), lestaurtinib (CEP-701), neratinib (HKI-272), nilotinib (TASIGNA®), semaxanib (semaxinib, SU5416), sunitinib (SUTENT®, SU11248), toceranib (PALLADIA®), vandetanib (ZACTIMA®, ZD6474), vatalanib (PTK787, PTK/ZK), trastuzumab (HERCEPTIN®), bevacizumab (AVASTIN®), rituximab (RITUXAN®), cetuximab (ERBITUX®), panitumumab (VECTIBIX®), ranibizumab (Lucentis®), nilotinib (TASIGNA®), sorafenib (NEXAVAR®), alemtuzumab (CAMPATH®), gemtuzumab ozogamicin (MYLOTARG®), ENMD-2076, PCI-32765, AC220, dovitinib lactate (TK1258, CHIR-258), BIBW 2992 (TOVOK™), SGX523, PF-04217903, PF-02341066, PF-299804, BMS-777607, ABT-869, MP470, BIBF 1120 (VARGATEF®), AP24534, JNJ-26483327, MGCD265, DCC-2036, BMS-690154, CEP-11981, tivozanib (AV-951), OSI-930, MM-121, XL-184, XL-647, XL228, AEE788, AG-490, AST-6, BMS-599626, CUDC-101, PD153035, pelitinib (EKB-569), vandetanib (zactima), WZ3146, WZ4002, WZ8040, ABT-869 (linifanib), AEE788, AP24534 (ponatinib), AV-951 (tivozanib), axitinib, BAY 73-4506 (regorafenib), brivanib alaninate (BMS-582664), brivanib (BMS-540215), cediranib (AZD2171), CHIR-258 (dovitinib), CP 673451, CYC116, E7080, Ki8751, masitinib (AB1010), MGCD-265, motesanib diphosphate (AMG-706), MP-470, OSI-930, Pazopanib Hydrochloride, PD173074, Sorafenib Tosylate (Bay 43-9006), SU 5402, TSU-68(SU6668), vatalanib, XL880 (GSK1363089, EXEL-2880). Selected tyrosine kinase inhibitors are chosen from sunitinib, erlotinib, gefitinib, or sorafenib. In one embodiment, the tyrosine kinase inhibitor is sunitinib.

In one embodiment, the multispecific or multifunctional molecule is administered in combination with one of more of: an anti-angiogenic agent, or a vascular targeting agent or a vascular disrupting agent. Exemplary anti-angiogenic agents include, but are not limited to, VEGF inhibitors (e.g., anti-VEGF antibodies (e.g., bevacizumab); VEGF receptor inhibitors (e.g., itraconazole); inhibitors of cell proliferatin and/or migration of endothelial cells (e.g., carboxyamidotriazole, TNP-470); inhibitors of angiogenesis stimulators (e.g., suramin), among others. A vascular-targeting agent (VTA) or vascular disrupting agent (VDA) is designed to damage the vasculature (blood vessels) of cancer tumors causing central necrosis (reviewed in, e.g., Thorpe, P. E. (2004) *Clin. Cancer Res*. Vol. 10:415-427). VTAs can be small-molecule. Exemplary small-molecule VTAs include, but are not limited to, microtubule destabilizing drugs (e.g., combretastatin A-4 disodium phosphate (CA4P), ZD6126, AVE8062, Oxi 4503); and vadimezan (ASA404).

Immune Checkpoint Inhibitors

In other embodiments, methods described herein comprise use of an immune checkpoint inhibitor in combination with the multispecific or multifunctional molecule. The methods can be used in a therapeutic protocol in vivo.

In embodiments, an immune checkpoint inhibitor inhibits a checkpoint molecule. Exemplary checkpoint molecules include but are not limited to CTLA4, PD1, PD-L1, PD-L2, TIM3, LAG3, CD160, 2B4, CD80, CD86, B7-H3 (CD276), B7-H4 (VTCN1), HVEM (TNFRSF14 or CD270), BTLA, KIR, MHC class I, MIHC class II, GAL9, VISTA, BTLA, TIGIT, LAIR1, and A2aR. See, e.g., Pardoll. Nat. Rev. Cancer 12.4(2012):252-64, incorporated herein by reference.

In embodiments, the immune checkpoint inhibitor is a PD-1 inhibitor, e.g., an anti-PD-1 antibody such as Nivolumab, Pembrolizumab or Pidilizumab. Nivolumab (also called MDX-1106, MDX-1106-04, ONO-4538, or BMS-936558) is a fully human IgG4 monoclonal antibody that specifically inhibits PD1. See, e.g., U.S. Pat. No. 8,008,449 and WO2006/121168. Pembrolizumab (also called Lambrolizumab, MK-3475, MK03475, SCH-900475 or KEYTRUDA®; Merck) is a humanized IgG4 monoclonal antibody that binds to PD-1. See, e.g., Hamid, O. et al. (2013) *New England Journal of Medicine* 369 (2): 134-44, U.S. Pat. No. 8,354,509 and WO2009/114335. Pidilizumab (also called CT-011 or Cure Tech) is a humanized IgG1k monoclonal antibody that binds to PD1. See, e.g., WO2009/101611. In one embodiment, the inhibitor of PD-1 is an antibody molecule having a sequence substantially identical or similar thereto, e.g., a sequence at least 85%, 90%, 95% identical or higher to the sequence of Nivolumab, Pembrolizumab or Pidilizumab. Additional anti-PD1 antibodies, e.g., AMP 514 (Amplimmune), are described, e.g., in U.S. Pat. No. 8,609,089, US 2010028330, and/or US 20120114649.

In some embodiments, the PD-1 inhibitor is an immunoadhesin, e.g., an immunoadhesin comprising an extracellular/PD-1 binding portion of a PD-1 ligand (e.g., PD-L1 or PD-L2) that is fused to a constant region (e.g., an Fc region of an immunoglobulin). In embodiments, the PD-1 inhibitor is AMP-224 (B7-DCIg, e.g., described in WO2011/066342 and WO2010/027827), a PD-L2 Fc fusion soluble receptor that blocks the interaction between B7-H1 and PD-1.

In embodiments, the immune checkpoint inhibitor is a PD-L1 inhibitor, e.g., an antibody molecule. In some embodiments, the PD-L1 inhibitor is YW243.55.S70, MPDL3280A, MEDI-4736, MSB-0010718C, or MDX-1105. In some embodiments, the anti-PD-L1 antibody is MSB0010718C (also called A09-246-2; Merck Serono), which is a monoclonal antibody that binds to PD-L1. Exemplary humanized anti-PD-L1 antibodies are described, e.g., in WO2013/079174. In one embodiment, the PD-L1 inhibitor is an anti-PD-L1 antibody, e.g., YW243.55.S70. The YW243.55.S70 antibody is described, e.g., in WO 2010/077634. In one embodiment, the PD-L1 inhibitor is MDX-1105 (also called BMS-936559), which is described, e.g., in WO2007/005874. In one embodiment, the PD-L1 inhibitor is MDPL3280A (Genentech/Roche), which is a human Fc-optimized IgG1 monoclonal antibody against PD-L1. See, e.g., U.S. Pat. No. 7,943,743 and U.S Publication No.: 20120039906. In one embodiment, the inhibitor of PD-L1 is an antibody molecule having a sequence substantially identical or similar thereto, e.g., a sequence at least 85%, 90%, 95% identical or higher to the sequence of YW243.55.S70, MPDL3280A, MEDI-4736, MSB-0010718C, or MDX-1105.

In embodiments, the immune checkpoint inhibitor is a PD-L2 inhibitor, e.g., AMP-224 (which is a PD-L2 Fc fusion soluble receptor that blocks the interaction between PD1 and B7-H1. See, e.g., WO2010/027827 and WO2011/066342.

In one embodiment, the immune checkpoint inhibitor is a LAG-3 inhibitor, e.g., an anti-LAG-3 antibody molecule. In embodiments, the anti-LAG-3 antibody is BMS-986016 (also called BMS986016; Bristol-Myers Squibb). BMS-986016 and other humanized anti-LAG-3 antibodies are described, e.g., in US 2011/0150892, WO2010/019570, and WO2014/008218.

In embodiments, the immune checkpoint inhibitor is a TIM-3 inhibitor, e.g., anti-TIM3 antibody molecule, e.g., described in U.S. Pat. No. 8,552,156, WO 2011/155607, EP 2581113 and U.S Publication No.: 2014/044728.

In embodiments, the immune checkpoint inhibitor is a CTLA-4 inhibitor, e.g., anti-CTLA-4 antibody molecule. Exemplary anti-CTLA4 antibodies include Tremelimumab (IgG2 monoclonal antibody from Pfizer, formerly known as ticilimumab, CP-675,206); and Ipilimumab (also called MDX-010, CAS No. 477202-00-9). Other exemplary anti-CTLA-4 antibodies are described, e.g., in U.S. Pat. No. 5,811,097.

INCORPORATION BY REFERENCE

All publications and patents mentioned herein are hereby incorporated by reference in their entirety as if each individual publication or patent was specifically and individually indicated to be incorporated by reference.

EXAMPLES

Example 1: Immunization of Armenian Hamster to Generate Anti-NKp30 Antibodies Briefly, armenian hamster were immunized with the extracellular domain of human NKp30 protein in complete Freund's adjuvant and boosted twice on day 14 and day 28 with NKp30 in incomplete Freund's adjuvant (IFA). On day 56 one more boost in IFA was given and the animals harvested three days later. Spleens were collected and fused with P3X63Ag8.653 murine myeloma cell line. 0.9×10^5 cells/well in 125 ul were seated in 96 well plate and feed with 125 μl of I-20+2ME+HAT (IMDM (4 g/L glucose) supplemented with 20% fetal bovine serum, 4 mM L-glutamine, 1 mM sodium pyruvate, 50 U penicillin, 50 μg streptomycin and 50 μM 2-ME in the absence or presence of HAT or HT for selection, and Hybridoma Cloning Factor (1% final) on days 7, 11 and thereafter as needed. At approximately 2 weeks after fusion (cells are about 50% confluent) supernatant was collected and assayed for binding.

Example 2: Hybridoma Screen for NKp30 mAbs

Expi293 cells were transfected with BC160 (hNKp30 cell antigen) 18 hours prior to screening. The day of screening, transfected cells were diluted to 0.05×10^6/mL and anti-Armenian hamster Fc Alexa Fluor 488 added to a final concentration of 0.4 ug/mL. 50 uL (2,500 cells) of this mixture was added to each well of a 384 well plate. The same density of untransfected 293 cells with secondary were used as a negative control. 5 uL of hybridoma supernatant was added to the cell mixture and the plate incubated for 1 hour at 37° C. The plates were then imaged on Mirrorball. Positive clones were identified and subcloned by serial dilution to obtain clonal selected hybridoma. After reconfirmation using the same protocols the hybridoma cells were harvested and the corresponding heavy and light chain sequences recovered. The DNA was subcloned into pcDNA3.4 for subsequent expression of the corresponding antibodies and further validation.

Example 3: Binding of NKp30 Antibodies to NK92 Cells

Figure 9:
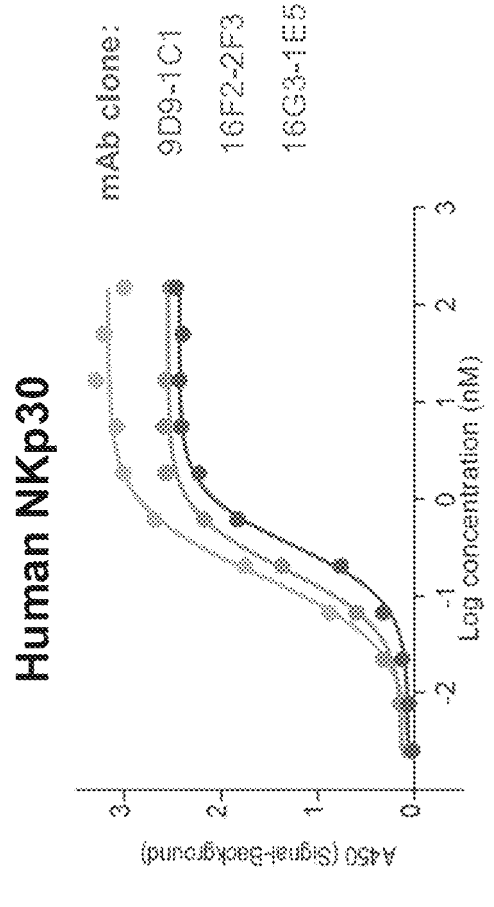
FIG. 9 is a graph showing binding of NKp30 antibodies to NK92 cells. Data was calculated as the percent-AF747 positive population.

NK-92 cells were washed with PBS containing 0.5% BSA and 0.1% sodium azide (staining buffer) and added to 96-well V-bottom plates with 200,000 cells/well. Hamster NKp30 antibodies were added to the cells in 2.0-fold serial dilutions and incubated for 1 hour at room temperature. The plates were washed twice with staining buffer. The secondary antibody against hamster Fe conjugated to AF647 (Jackson, 127-605-160) was added at 1:100 dilution (1.4 mg/ml stock) and incubated with the cells for 30 minutes at 4° C. followed by washing with staining buffer. Cells were subsequently were fixed for 10 minutes with 4% paraformaldehyde at room temperature. The plates were read on CytoFLEX LS (Beckman Coulter). Data was calculated as the percent-AF747 positive population (FIG. 9).

Figure 10:
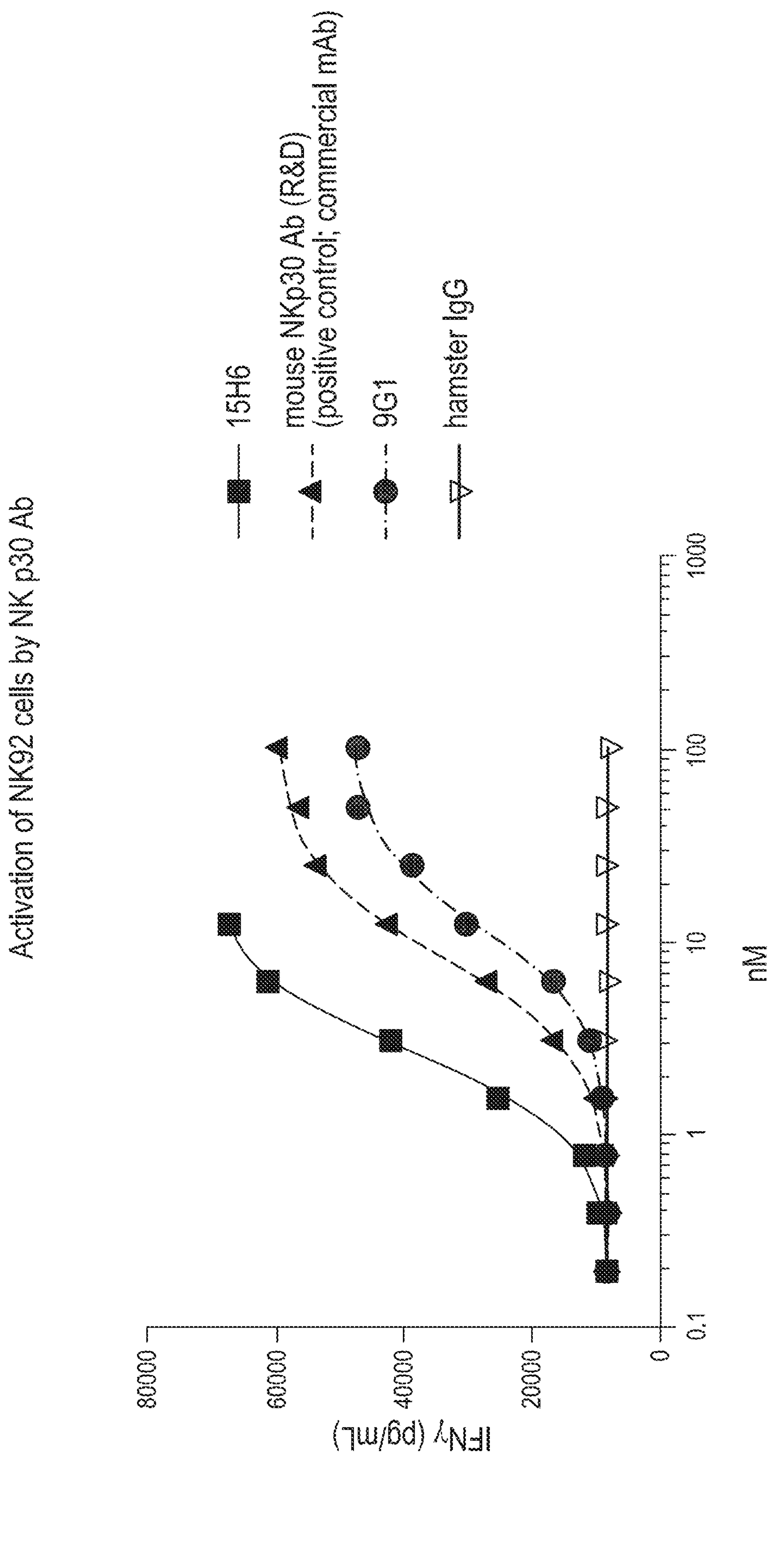
FIG. 10 is a graph showing activation of NK92 cells by NKp30 antibodies. Data were generated using hamster anti-NKp30 mAbs.

Example 4: Bioassay to Measure Activity of NKp30 Antibodies Using NK92 Cell Line NKp30 antibodies were three-fold serially diluted in PBS and incubated at 2-8 C° overnight in flat bottom 96 well plates. Plates were washed twice in PBS and 40,000 NK-92 cells were added in growth medium containing IL-2. Plates were incubated at 37 C°, 5% C02, humidified incubator for 16-24 hours before supernatants were collected. IFNγ levels in supernatants was measured following MSD assay instructions (FIG. 10). Supernatant collected from cells incubated with hamster isotype IgG was used as negative control and supernatants from cells incubated with NKp30 monoclonal antibody (R&D, clone 210847) was utilized as a positive control. Data were generated using hamster anti-NKp30 mABs.

Example 5: ELISA to Measure Binding of Humanized JOVI.1 Variant to Human TRBC1

Figure 7:
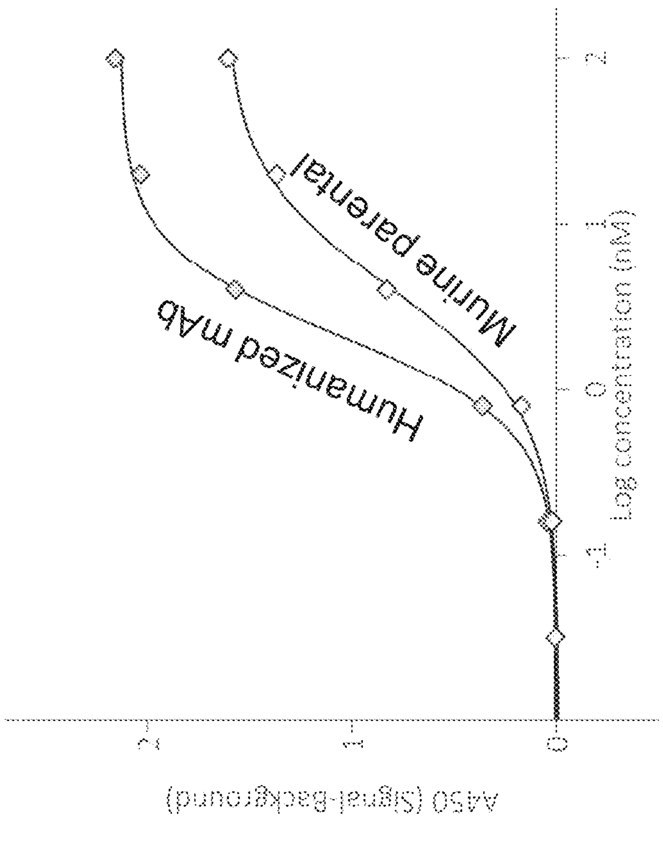
FIG. 7 is a graph showing binding of JOVI.1 and humanized JOVI.1 to human TRBC1.

An ELISA assay was performed to assay binding of a humanized JOVI.1 variant to human TRBC1. Microplates were coated with 1 μg/mL of each JOVI.1 variant separately in 100 uL and blocked with 2% BSA. Serial dilutions of hTRBC1, BIM0444 (7 points, 5-fold dilutions, 100 nM to 6.4 pM) were transferred to the coated and blocked plates at 100 uL/well and incubated for 1 hr at room temperature. Plates were washed three times and incubated for 30 mins with anti-his tag Fc horseradish peroxidase conjugate followed by addition of TMB, a substrate of HRP. The plates were developed for 5 mins, stopped with 1M HCL and read at a wavelength of 450 nm. The ELISA data show direct binding of anti-TRBC1 mAbs (bivalent) to human TRBC1 (FIG. 7).

Example 6: Assay to Measure Binding of Humanized JOVI.1 Variant to Human TRBC1

An Octet assay was performed to check binding of JOVI.1 humanized variants. Protein A biosensors were equilibrated in PBS at 25° C. The sensors were loaded with hTRBC1, BIM0444 at 20 μg/mL in PBS to a response of 1.5 nM followed by serial dilutions of JOVI1.1 fabs, BIM0446 and BIM0460 (7 points, 2-fold dilutions, 50 nM to 0.78 nM).

Further Octet parameters include:

Baseline: 30 sec in PBS

Load: 20 sec to a response of 1.5 nm

Baseline: 60 sec

Association: 60 sec

Dissociation: 60 sec in PBS

Figure 8:
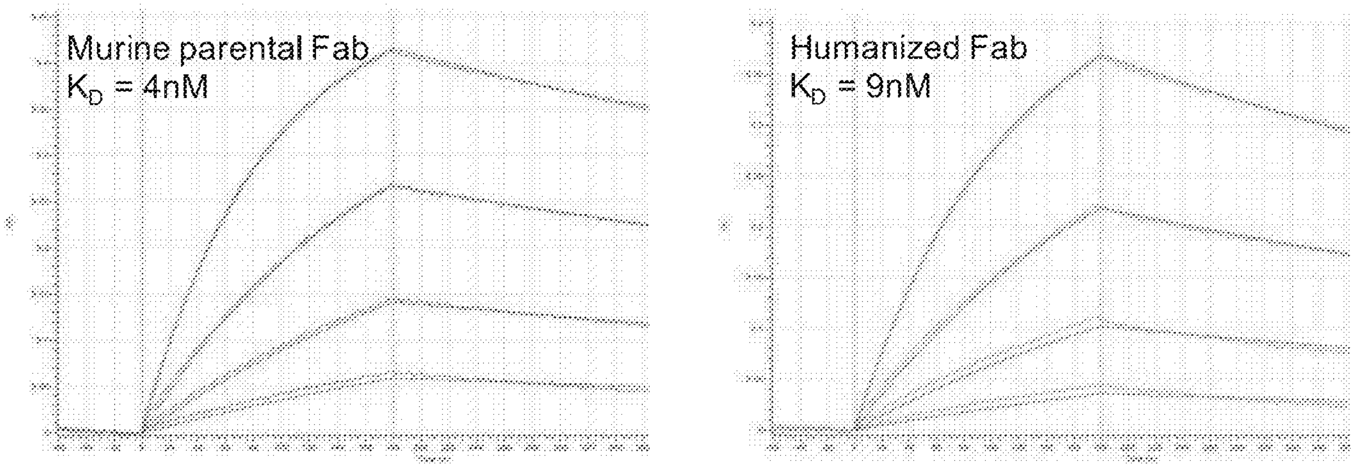
FIG. 8 is a set of graphs showing binding of JOVI.1 Fab (left) and humanized JOVI.1 Fab to human TRBC1 (right).

Octet data showed binding of anti-TRBC1 Fabs to hTRBC1 (FIG. 8). hTRBC1 was captured on the sensor tip and dipped in solution containing different concentrations of monovalent Fabs.

Example 7: Generation and Characterization of Humanized Anti-NKp30 Antibodies

A series of hamster anti-NKp30 antibodies were selected. These antibodies were shown to bind to human NKp30 and cynomolgus NKp30 and induce IFNγ production from NK-90 cells (data not shown). The $V_H$ and VL sequences of exemplary hamster anti-NKp30 antibodies 15E1, 9G1, 15H6, 9D9, 3A12, and 12D10 are disclosed in Table 25. The $V_H$ and VL sequences of exemplary humanized anti-NKp30 antibodies based on 15E1, 9G1, and 15H6 are also disclosed in Table 25. The Kabat CDRs of these antibodies are disclosed in Table 21A or Table 21B, and Table 22.

Two humanized constructs based on 15E1 were selected. The first construct BJM0407 is a Fab comprising a heavy chain variable region comprising the amino acid sequence of SEQ ID NO: 7302 and a lambda light chain variable region comprising the amino acid sequence of SEQ ID NO: 7305. Its corresponding scFv construct BJM0859 comprises the amino acid sequence of SEQ ID NO: 7310. The second construct BJM0411 is a Fab comprising a heavy chain variable region comprising the amino acid sequence of SEQ ID NO: 7302 and a kappa light chain variable region comprising the amino acid sequence of SEQ ID NO: 7309. Its corresponding scFv construct BJM0860 comprises the amino acid sequence of SEQ ID NO: 7311. BJM0407 and BJM0411 showed comparable biophysical characteristics, e.g., binding affinity to NKp30 and thermal stability. The scFv constructs BJM0859 and BJM0860 also showed comparable biophysical properties.

Example 8: Generation and Characterization of Humanized Anti-TRBC1 Antibodies

The murine anti-TRBC1 antibody JOVI.1 was humanized, leading to a number of humanized variants. The $V_H$ and VL sequences of exemplary humanized variants are disclosed in Table 7. One humanized variant BIM0460 was selected, which comprises a $V_H$ comprising the amino acid sequence of SEQ ID NO: 253 and a VL comprising the amino acid sequence of SEQ ID NO: 258. BIM0460 was further modified by germlining, leading to a number of germlined variants. The $V_H$ and VL sequences of exemplary germlined variants are also disclosed in Table 7. One germlined variant BJM0578 was selected, which comprises a $V_H$ comprising the amino acid sequence of SEQ ID NO: 7351 and a VL comprising the amino acid sequence of SEQ ID NO: 258. The Kabat CDRs of these humanized and germlined variants are disclosed in Table 3 and Table 4. BIM0460 was shown to bind to human TRBC1 with an affinity of 17 nM. BJM0578 was shown to bind to human TRBC1 with an affinity of 110 nM.

Example 9: Cytokine Secretion and T Cell Activation Profiling

This example explores whether ADCC-disabled formats would be preferable for antibodies that bind to TRBC1 and NKp30. JOVI.1 engagement upon plate coating or in solution upon Fc engagement induced T cell proliferation and activation (data not shown). This could be a liability for treating patients with T cell lymphoma, e.g., patients with peripheral T-cell lymphoma (PTCL).

Figure 11A:
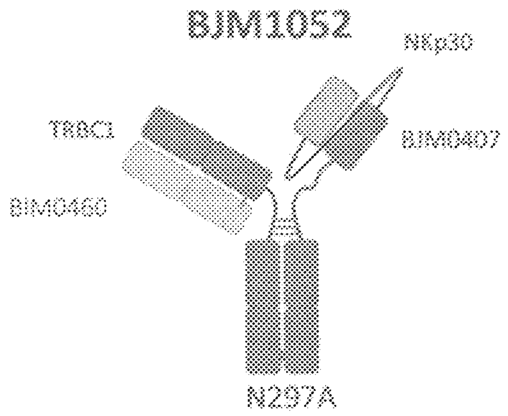
FIGS. 11A-11E are schematic representations of anti-TRBC1/NKp30 antibodies and control molecules.
Figure 11B:
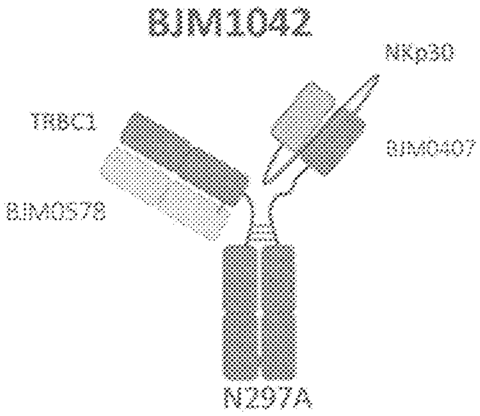
Figure 11C:
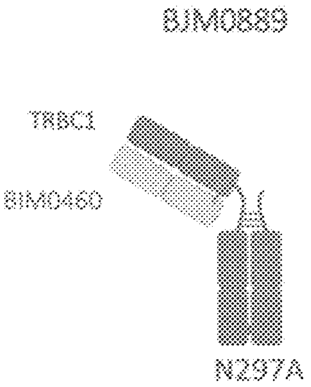
Figure 11D:
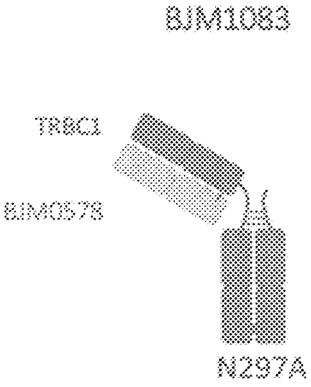
Figure 11E:
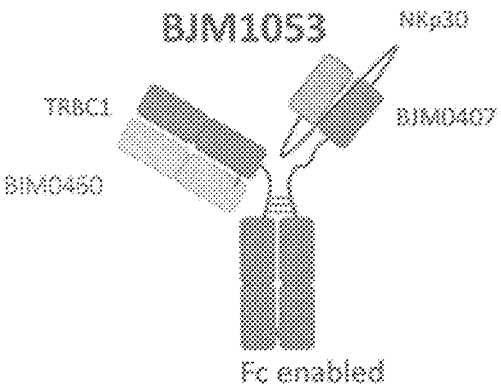

Five constructs were generated as shown in FIGS. 11A-11E. BJM1052 is a bispecific antibody comprising an anti-TRBC1 Fab (based on BIM0460) and an anti-NKp30 scFv (based on BJM0407) (FIG. 11A). BJM1052 comprises the amino acid sequences of SEQ ID NO: 7379 (anti-TRBC1 HC), SEQ ID NO: 7380 (anti-TRBC1 LC), and SEQ ID NO: 7383 (anti-NKp30 scFv-Fc). BJM1052 comprises an N297A mutation in its Fc region. BJM1042 is a bispecific antibody comprising an anti-TRBC1 Fab (based on BJM0578) and an anti-NKp30 scFv (based on BJM0407) (FIG. 11B). BJM1042 comprises the amino acid sequences of SEQ ID NO: 7382 (anti-TRBC1 HC), SEQ ID NO: 7380 (anti-TRBC1 LC), and SEQ ID NO: 7383 (anti-NKp30 scFv-Fc). BJM1042 comprises an N297A mutation in its Fc region. BJM0889 is a single arm antibody comprising an anti-TRBC1 Fab (based on BIM0460) (FIG. 11C). BJM1083 is a single arm antibody comprising an anti-TRBC1 Fab (based on BJM0578) (FIG. 11D). Both BJM0889 and BJM1083 comprise an N297A mutation in the Fc region. BJM1083 comprises a light chain, having a sequence of SEQ ID NO: 8307; and an heavy chain having a sequence of SEQ ID NO: 8309). BJM1053 is similar to BJM1052, except that BJM1053 has an ADCC enabled Fc region.

Figure 12A:
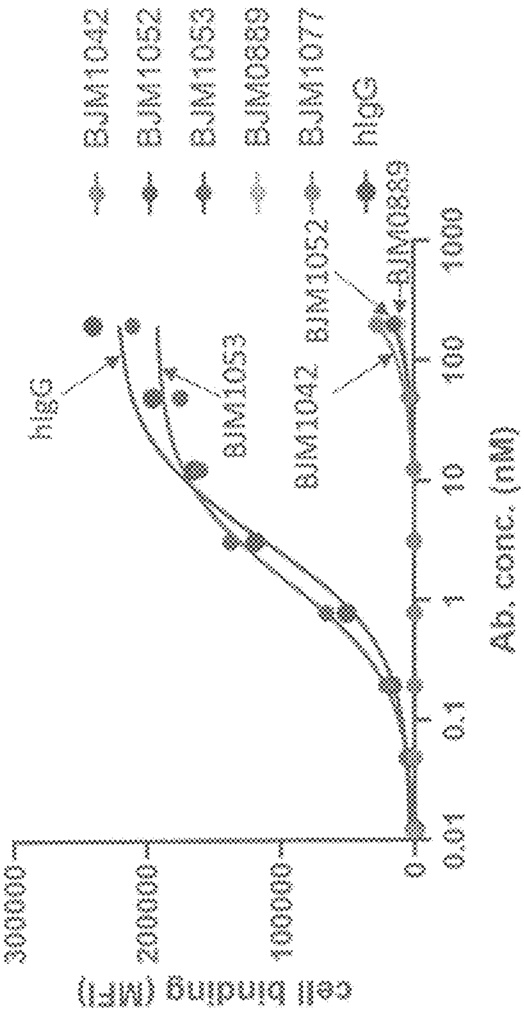
FIGS. 12A and 12B are graphs showing binding of antibodies to Fcγ receptor-expressing THP1 cells.
Figure 12B:
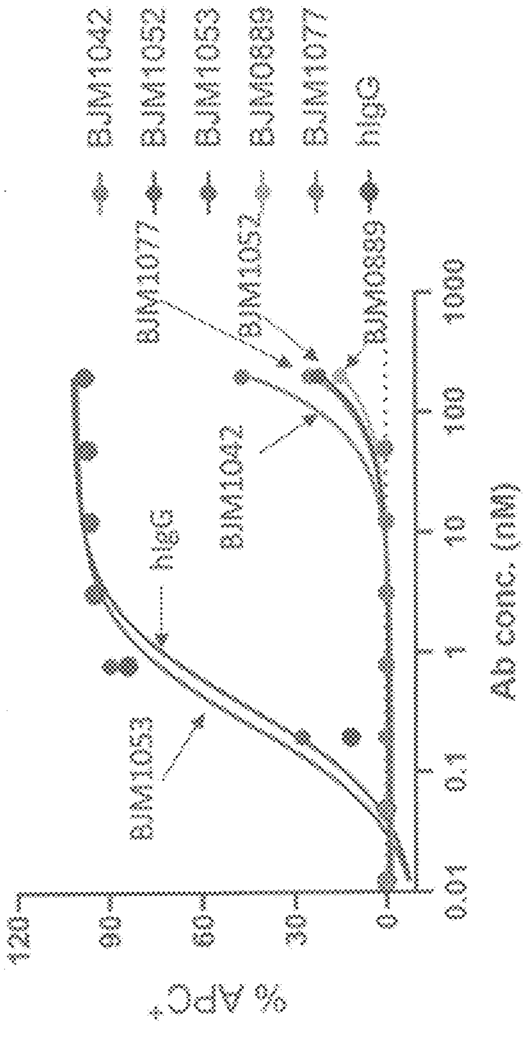

As shown in FIGS. 12A and 12B, Fc enabled antibodies BJM1053 and hIgG1 bound to THP1 cells which express Fcγ receptors, whereas N297A mutated antibodies (BJM1052, BJM1042, and BJM0889) did not show significant binding.

Figure 13A:
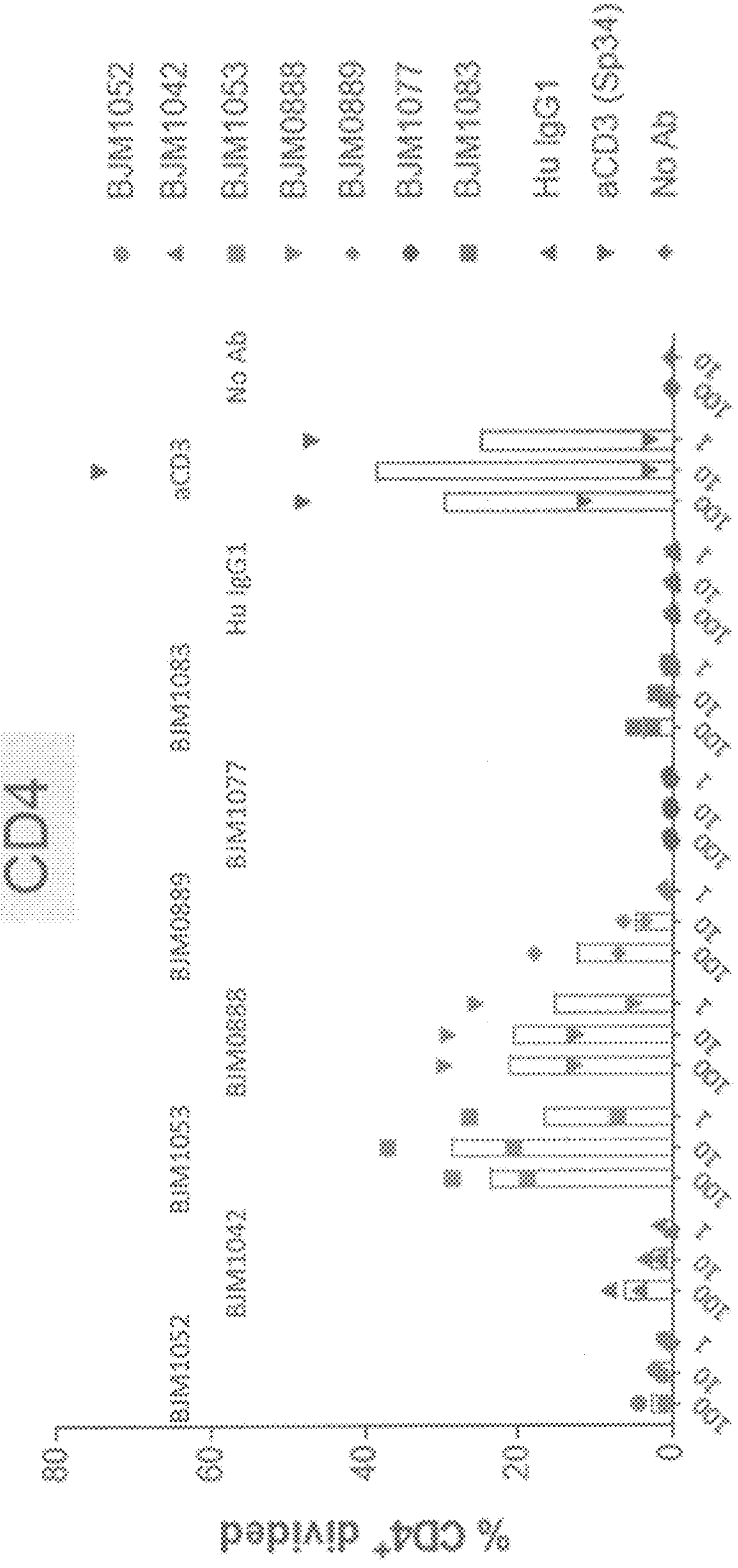
FIGS. 13A-13D are graphs showing T cell activation after incubation with the indicated antibodies.
Figure 13B:
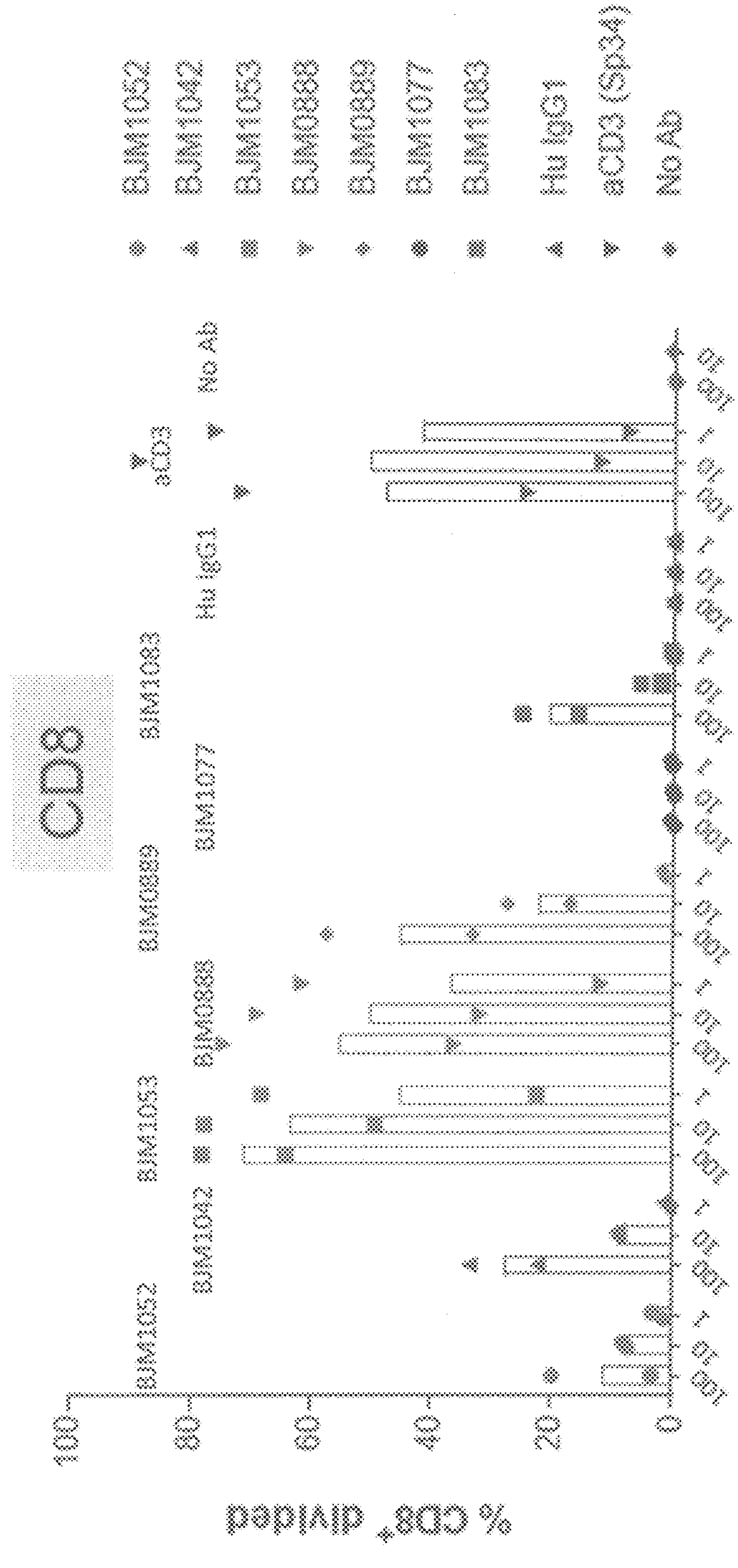
Figure 13C:
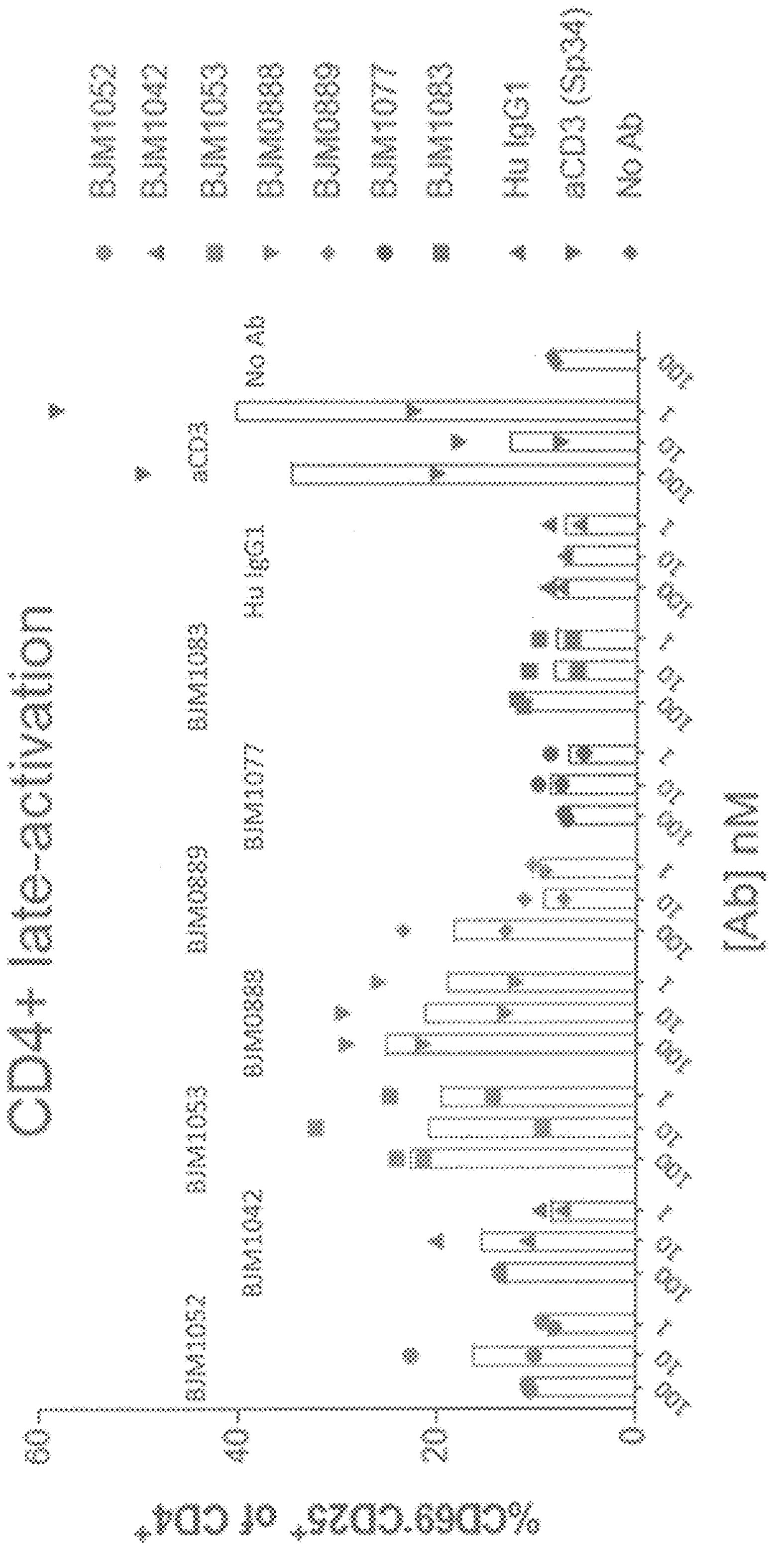
Figure 13D:
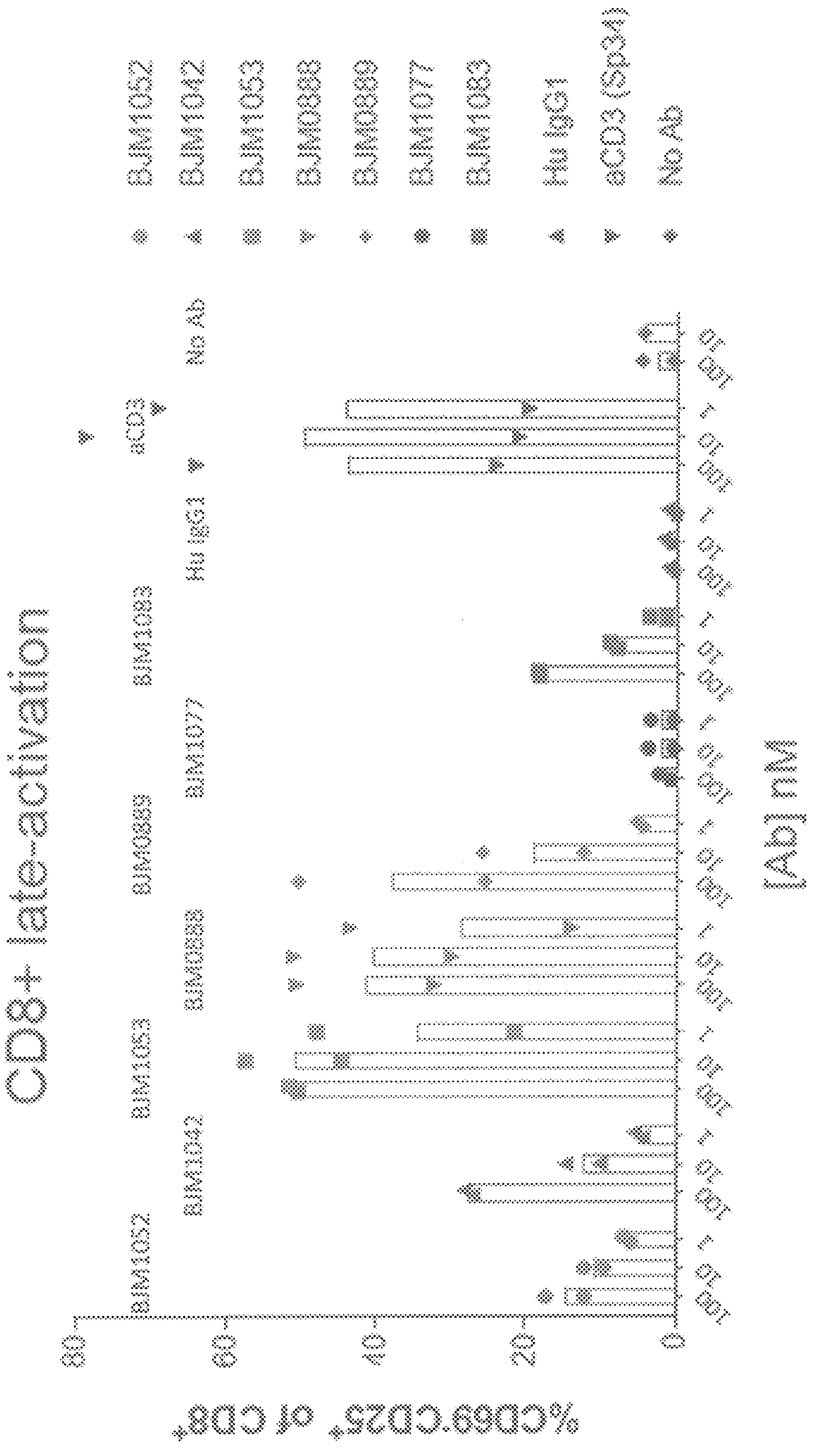

To test if antibodies with N297A mutation (Fc disabled) are safer, anti-TRBC1/NKp30 antibodies and control molecules were added to PBMCs in solution at 100, 10 or 1 nM and T cell proliferation was measured on Days 1 and Day 5. Fe disabled antibodies BJM1052 and BJM1042 showed less lymphocyte clustering than the Fe enabled antibody BJM1053 (data not shown). T cell activation was significantly reduced in PBMCs treated with BJM1052 and BJM1042 on Day 5, as demonstrated by the percentage of proliferating T cells (FIGS. 13A and 13B) as well as the percentage of CD69-CD25+ T cells (FIGS. 13C and 13D).

Example 10: In Vitro Binding to TRBC1 and NKp30

Various constructs were generated as shown in FIGS. 14A-14D. Shown in FIG. 14A is a bispecific antibody comprising an anti-TRBC1 Fab (based on BIM0460 or BJM0578) and an anti-NKp30 scFv (based on BJM0407 or BJM0411). The bispecific antibodies may or may not have an N297A mutation in their Fc regions. The molecules listed in FIG. 14B have the configuration shown in FIG. 14A.

FIG. 14C shows a bispecific antibody comprising an anti-TRBC1 Fab (based on BIM0460 or BJM0578) and an anti-NKp30 Fab (based on BJM0407 or BJM0411). The bispecific antibodies may or may not have an N297A mutation in their Fc regions. The molecules listed in FIG. 14D have the configuration shown in FIG. 14C.

Figure 15A:
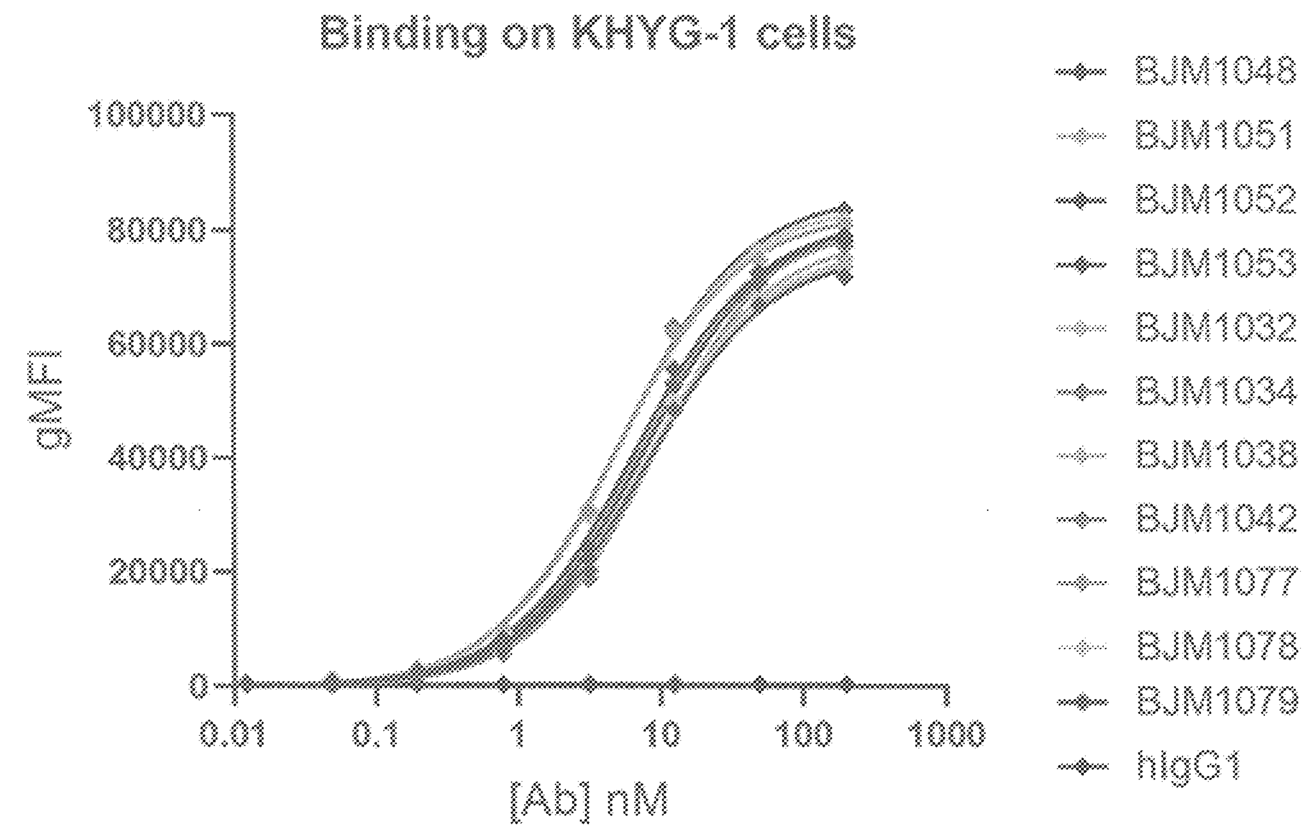
Figure 15B:
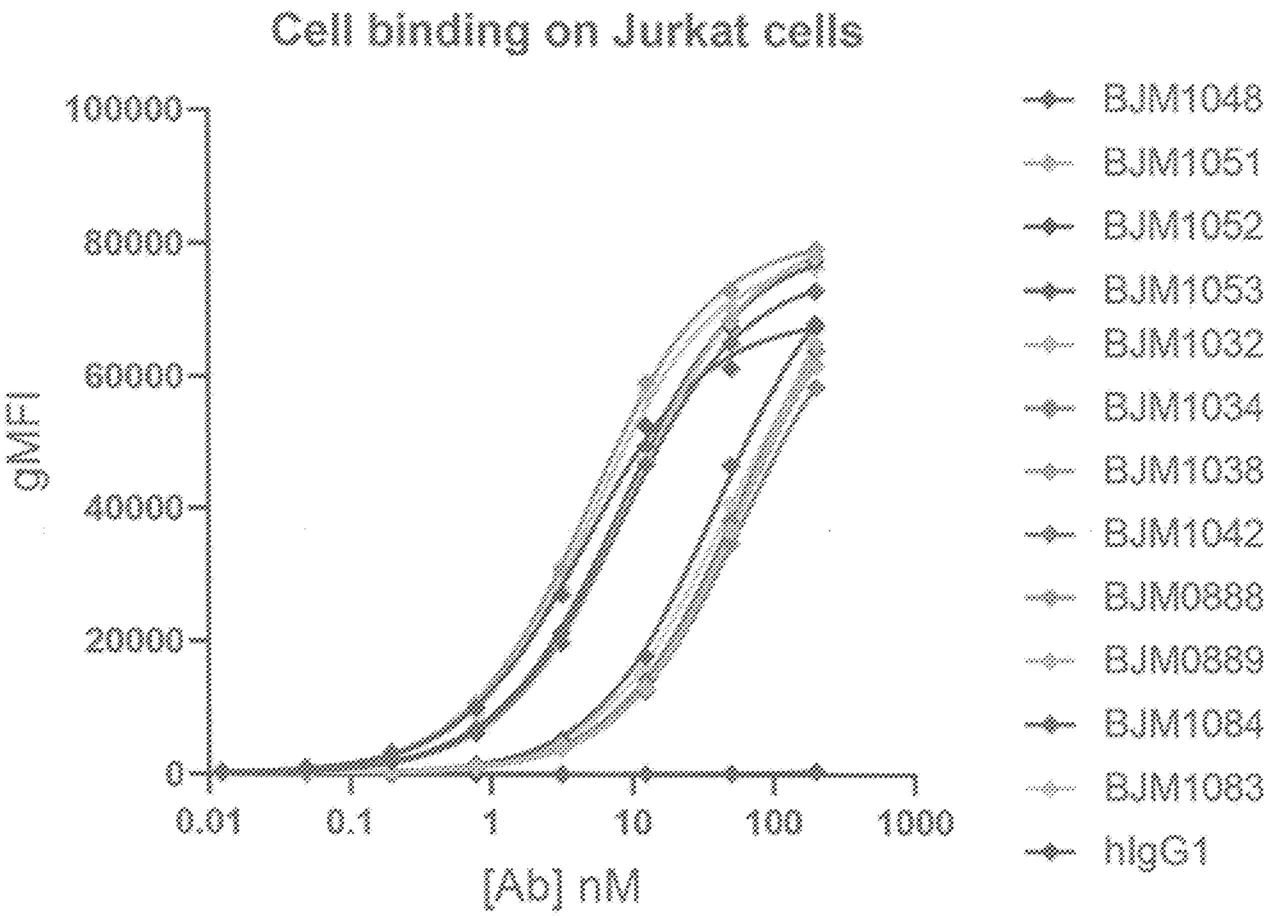

All the anti-TRBC1/NKp30 antibodies tested exhibited binding to NK cell line KHYG-1 (FIGS. 15A and 15D) as well as TRBC1+ Jurkat cells (FIGS. 15B and 15D).

Example 11: In Vitro Cytolysis of TRBC1+ Cell Lines

In this example, anti-TRBC1/NKp30 antibodies were tested for their ability to induce killing of TRBC1-expressing cells in the presence of NK cells. The antibodies tested in this Example are shown in FIGS. 11A-11E.

Figure 16A:
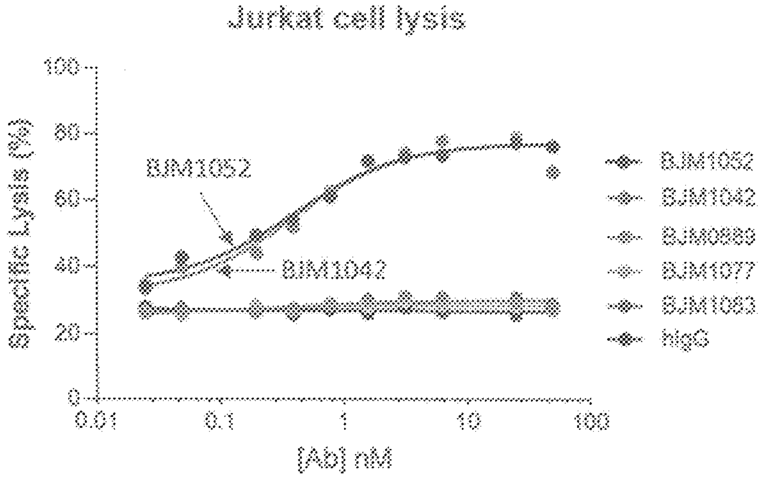
FIGS. 16A-16C are graphs showing killing of TRBC1+ target cells in the presence of NK-92 effector cells. The target cells are TRBC1+ Jurkat cells (FIG. 16A) or H9 cells (FIG. 16B). TRBC2+ HPB-ALL cells were used as a control (FIG. 16C).
Figure 16B:
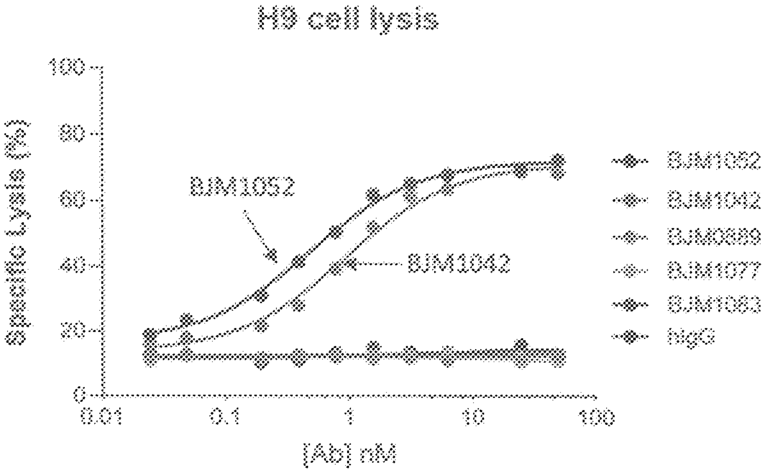
Figure 16C:
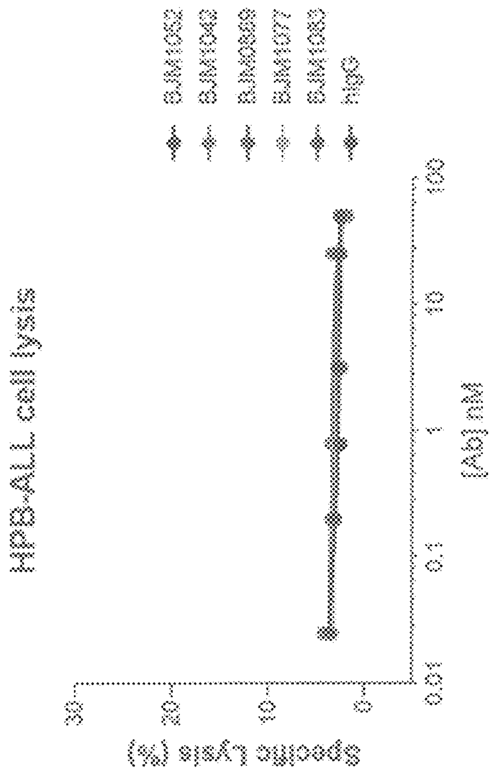

In a first study, NK-92 effector cells were cultured in 5:1 ratio with CFSE labeled target cells for 4h. Target cell lysis was measured using flow cytometry and gating on dead target cells. Anti-TRBC1/NKp30 bispecific antibodies BJM1052 and BJM1042 induced killing of TRBC1+ Jurkat cells (FIG. 16A) and H9 cells (FIG. 16B), but not TRBC2+ HPB-ALL cells (FIG. 16C), in the presence of NK-92 effector cells.

Figure 17A:
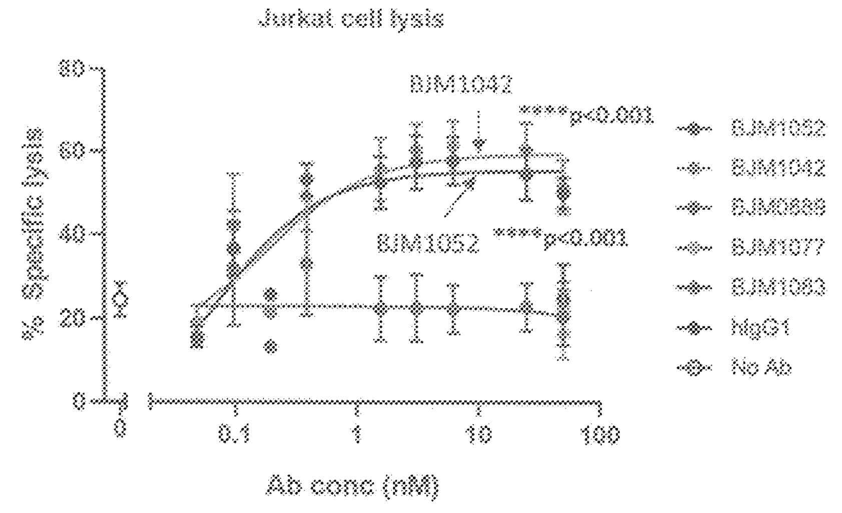
FIGS. 17A-17C are graphs showing killing of TRBC1+ target cells in the presence of primary NK cells. The target cells are TRBC1+ Jurkat cells (FIG. 17A) or H9 cells (FIG. 17B). TRBC2+ HPB-ALL cells were used as a control (FIG. 17C).
Figure 17B:
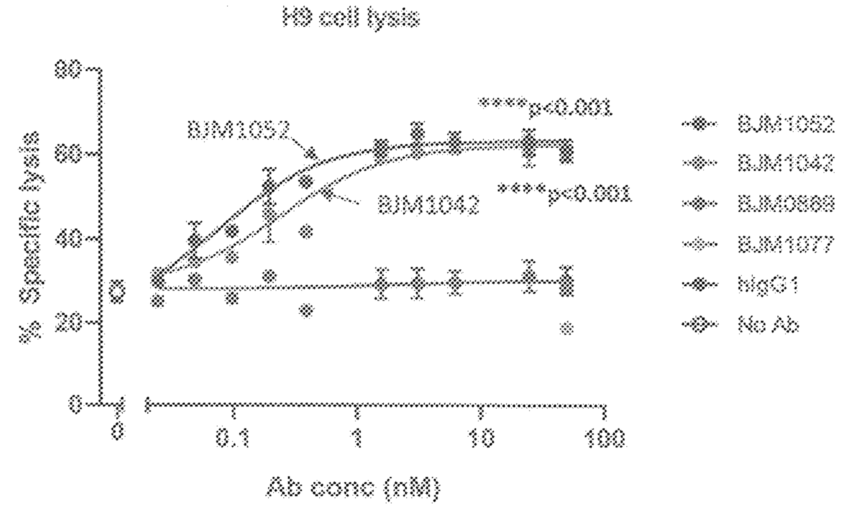
Figure 17C:
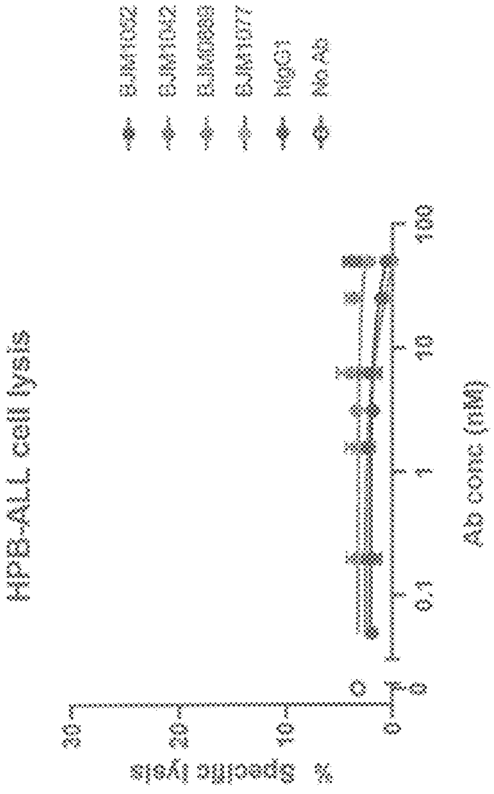

In a second study, primary NK cells were cultured in 5:1 ratio with CFSE labeled target cells for 4h. For H9 cells, 10:1 E:T ratio was used. Target cell lysis was measured using flow cytometry. Anti-TRBC1/NKp30 bispecific antibodies BJM1052 and BJM1042 induced killing of TRBC1+ Jurkat cells (FIG. 17A) and H9 cells (FIG. 17B), but not TRBC2+ HPB-ALL cells (FIG. 17C), in the presence of primary NK cells.

Figure 18A:
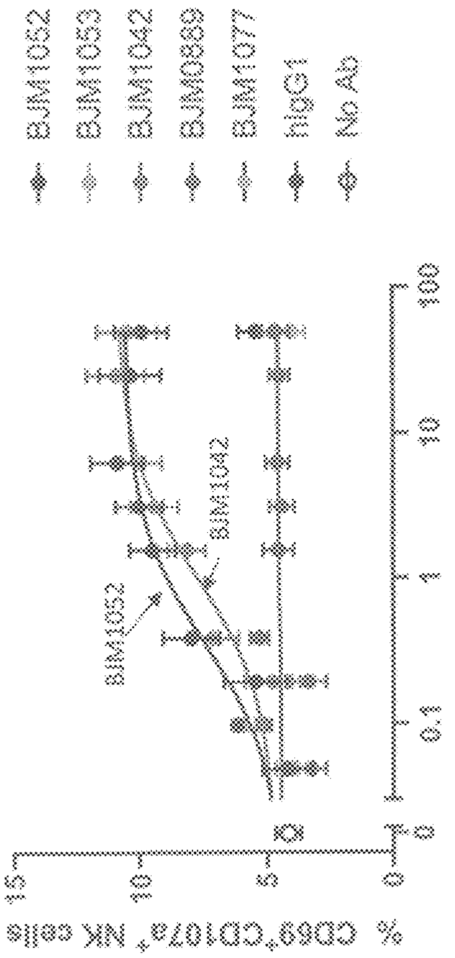
FIGS. 18A-18C are graphs showing activation of NK cells after co-culture with TRBC1+ Jurkat cells in the presence of anti-TRBC1/NKp30 antibodies.
Figure 18B:
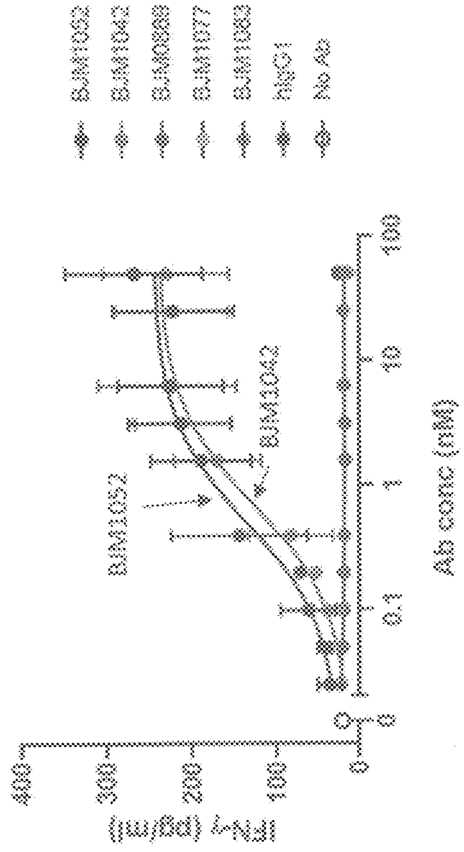
Figure 18C:
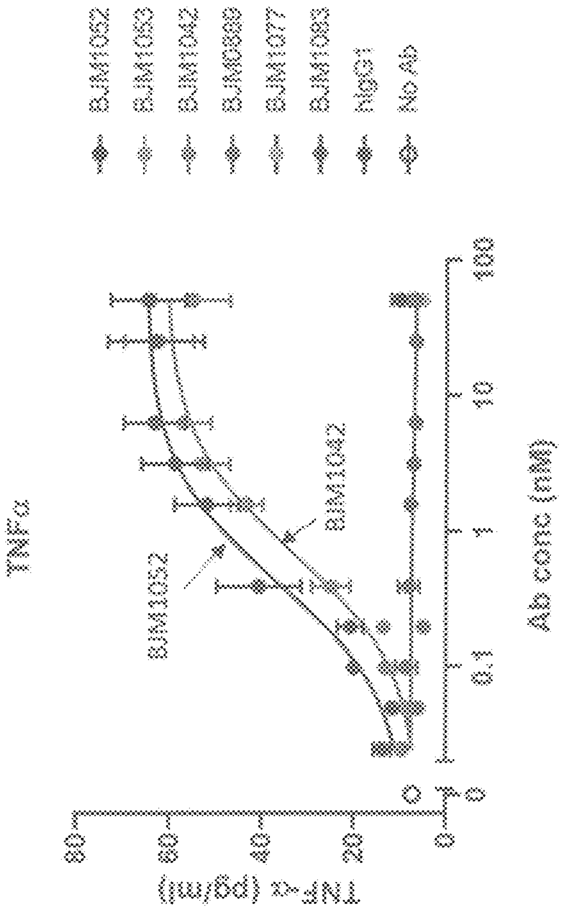

In a third study, NK cells and target cells were co-cultured for 4 hours in the presence of anti-TRBC1/NKp30 antibodies BJM1052 and BJM1042, supernatants were collected, and cytokine levels were measured using MSD. Target cell lysis correlated with NK cell activation, as demonstrated by the percentage of CD69+CD107a+ NK cells (FIG. 18A), IFNγ secretion (FIG. 18B), and TNFα secretion (FIG. 18C).

Figure 19A:
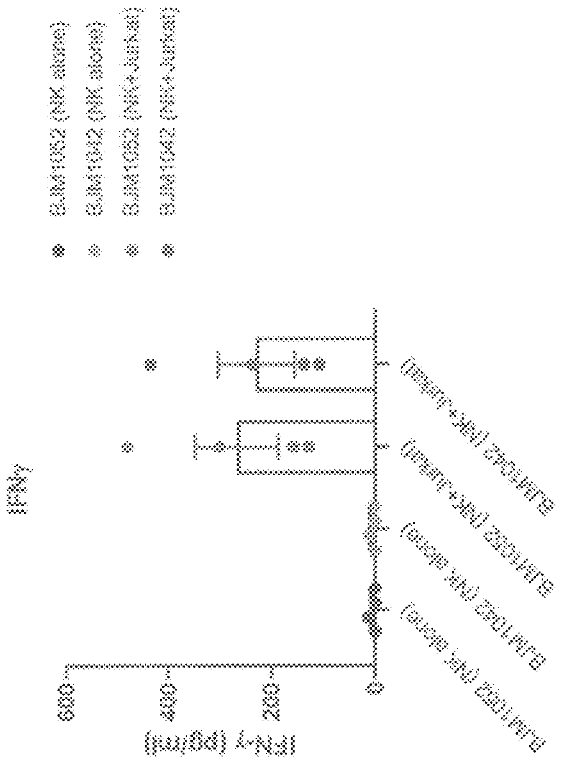
FIGS. 19A and 19B are graphs showing cytokine levels produced by NK cells in the presence or absence of TRBC1+ Jurkat cells.
Figure 19B:
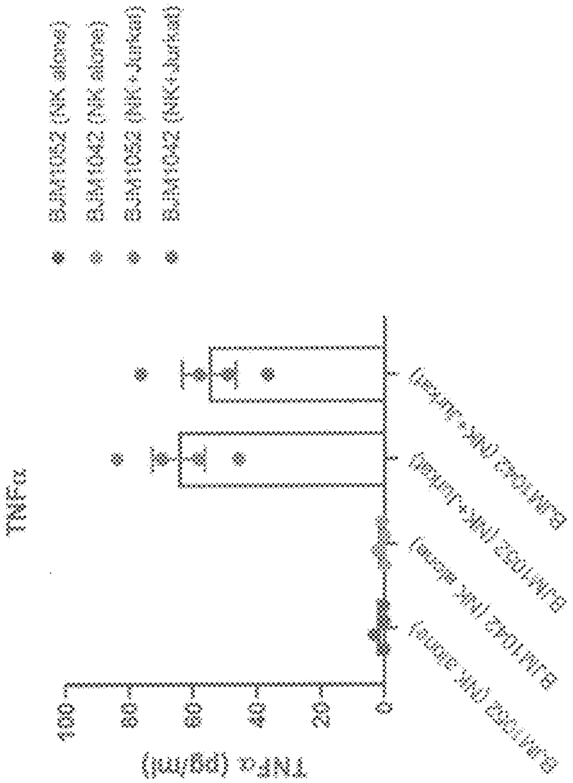

The next study examines whether anti-TRBC1/NKp30 antibodies BJM1052 and BJM1042 activates NK cells in the absence of target cells. Primary NK cells were incubated with 50 nM of antibodies for 4h in the absence of target cells, and then supernatants were collected to measure IFNγ and TNFα levels. As shown in FIGS. 19A and 19B, NK cell activation mediated by anti-TRBC1/NKp30 antibodies required the presence of both NK cells and target cells.

Figure 20:
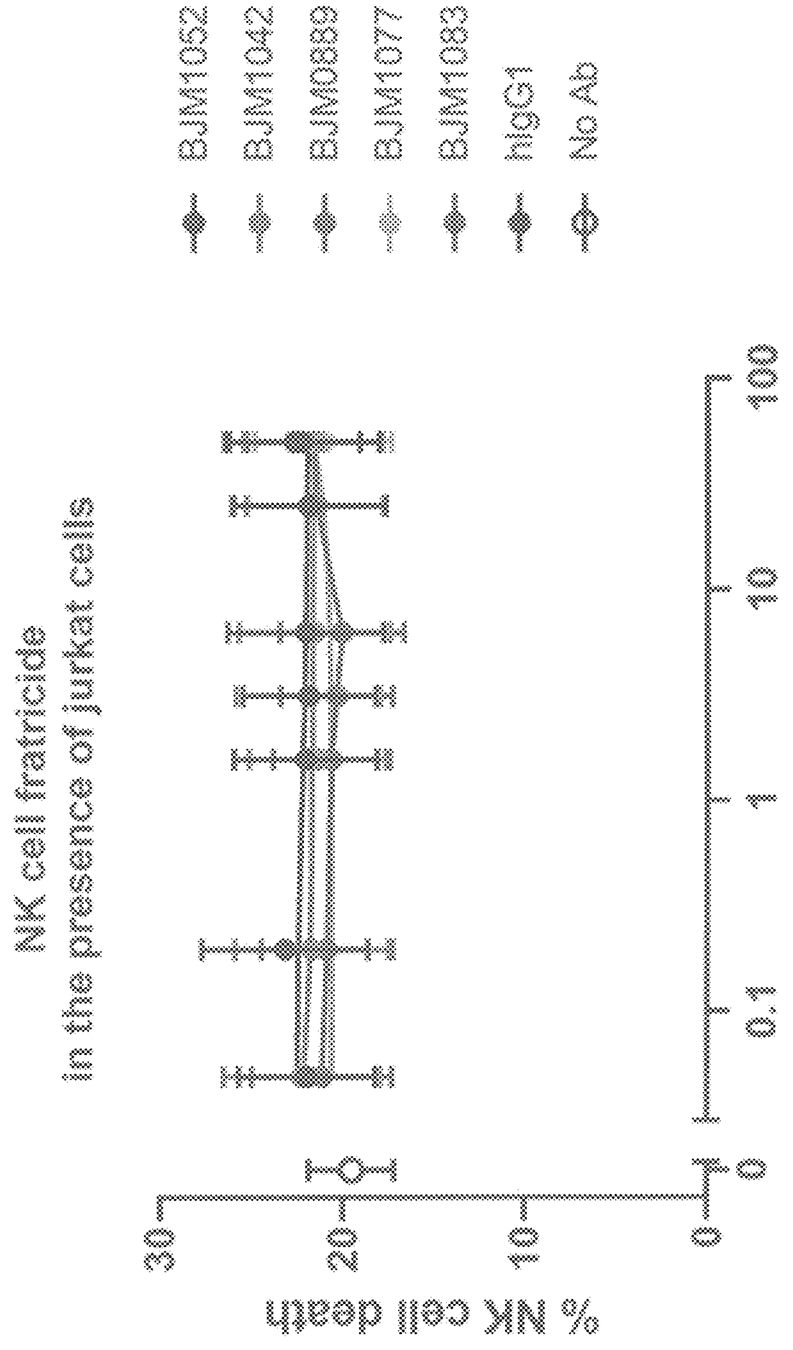
FIG. 20 is a graph showing % NK cell death induced by the indicated antibodies in the presence of TRBC1+ Jurkat cells.

Finally, anti-TRBC1/NKp30 antibodies BJM1052 and BJM1042 did not induce NK cell death in the presence of target cells (FIG. 20).

Example 12: Selective In Vitro Cytolysis of Patient-Derived TRBC1+ PDX

Common subtypes of T-cell lymphoma include: Peripheral T-Cell Lymphoma, Not Otherwise Specified (PTCL-NOS); Anaplastic Large Cell Lymphoma (ALCL); Angioimmunoblastic T-Cell Lymphoma (AITL); and Cutaneous T-Cell Lymphoma (CTCL). Uncommon subtypes of T-cell lymphoma include: Adult T-Cell Leukemia/Lymphoma (ATLL); T-Cell Lymphoblastic Lymphoma; Hepatosplenic Gamma-Delta T-Cell Lymphoma; Enteropathy-Type T-Cell Lymphoma; Nasal NK/T-Cell Lymphomas; Treatment-Related T-Cell Lymphomas. Similar frequency and expression of TRBC1 was observed in PBMCs isolated from healthy donors and PBMCs isolated from PTCL patients (data not shown).

Two Patient-Derived Xenograft (PDX) samples were tested to be TRBC1 positive: PDX3 was derived from a patient with Acute Lymphoblastic Leukemia (T-ALL), and PDX6 was derived from a patient with Primary cutaneous CD30+ T-Cell Lymphoproliferative Disorder (CTCL).

Figure 21A:
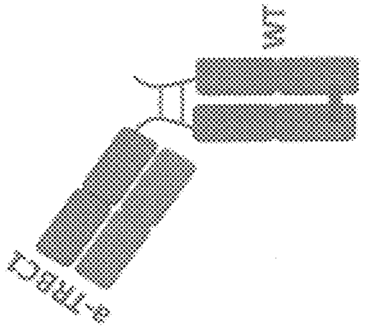
FIGS. 21A and 21B are schematic representations of a single arm anti-TRBC1 antibody and a bispecific anti-TRBC1/NKp30 antibody, respectively.
Figure 21B:
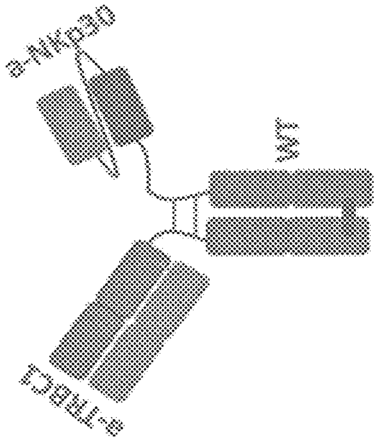

The antibodies shown in FIGS. 21A and 21B were used in a functional killing assay. BJM0145 is a single arm anti-TRBC1 antibody. BJM0773 is a bispecific antibody comprising an anti-TRBC1 Fab and an anti-NKp30 scFv. PDX samples were labeled with CFSE, cultured with primary NK cells or KHYG1 cells at 5:1 ratio of E:T for 5 hours in the presence of BJM0145 or BJM0773 (0.01-10 nM). Specific killing was measured using the following calculation:

$$\frac{\text{\% dead treated (PDX+NK)}-\text{\% dead PDX}}{\text{100\% (Max killing)}-\text{\% dead PDX}}$$

Figures 22A, 22B, 22C, 22D:
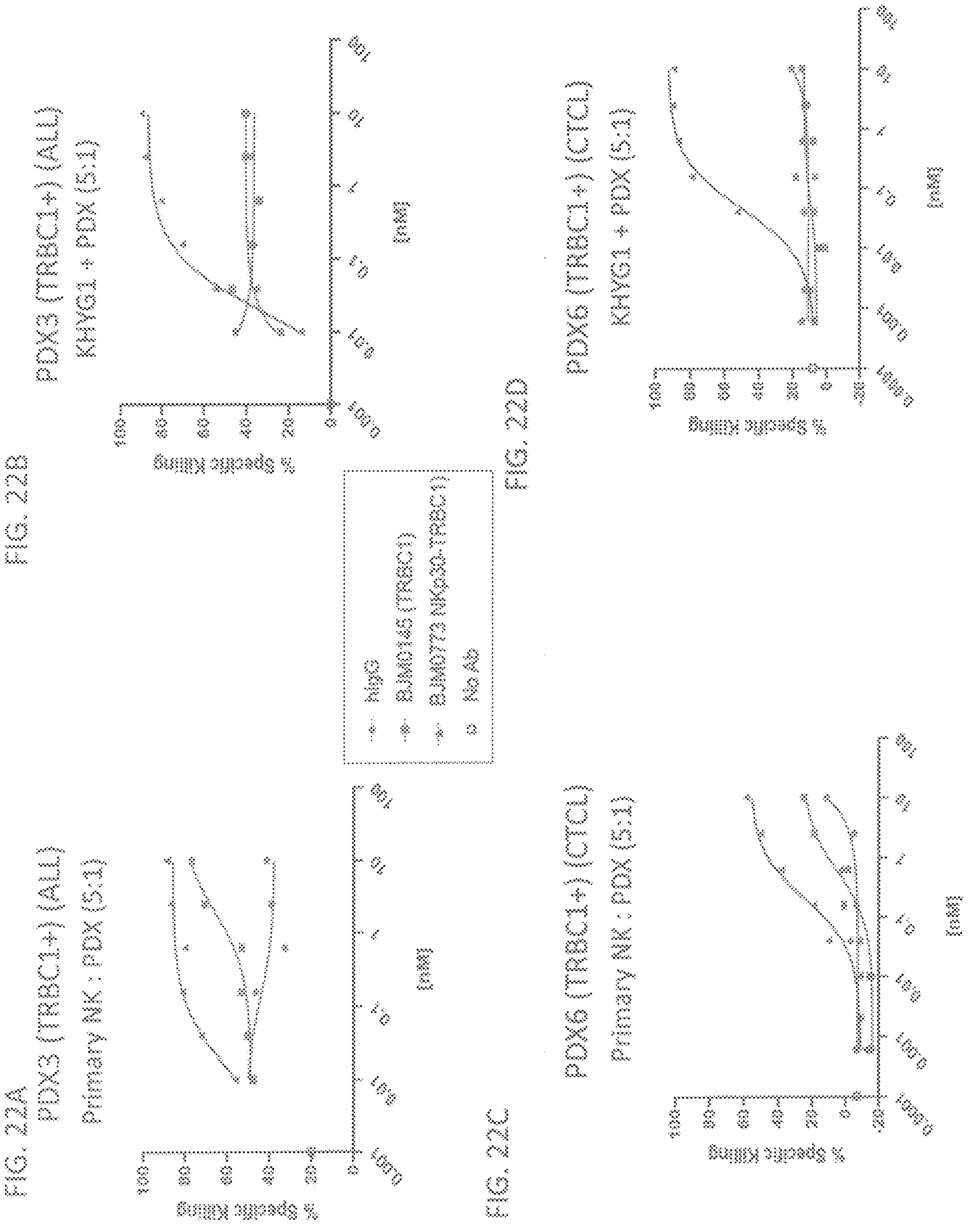
FIGS. 22A-22D are graphs showing NK cell-mediated killing of TRBC1+ PDX in the presence of the indicated antibodies.

As shown in FIGS. 22A-22D, anti-TRBC1/NKp30 antibody BJM0773 efficiently killed TRBC1 positive PDX3 and PDX6. The single arm anti-TRBC1 antibody BJM0145 exhibited weak killing in the presence of primary NK cells due to ADCC (FIGS. 22A and 22C), but not in the presence of KHYG1 cells, which are CD16 deficient NK cells (FIGS. 22B and 22D). The single arm anti-TRBC1 antibody or the bispecific anti-TRBC1/NKp30 antibody did not kill TRBC1 negative PDX (data not shown).

Example 13: In Vitro Cytolysis of TRBC1+ Jurkat Cells Using NK Cells from PTCL Patients This example examines whether anti-TRBC1/NKp30 antibodies can mediate killing of TRBC1+ target cells in the presence of NK cells isolated from PTCL patients.

NK cells and NKp30+ NK cells are present in normal proportions in PTCL patient PBMCs (data not shown). NK cells were enriched from PTCL patients and healthy donor PBMCs by negative selection and then incubated overnight with 200U/ml IL-2. On the following day, NK cells were co-cultured with Jurkat cells for 4h in the presence of 10 nM antibodies.

Figure 23:
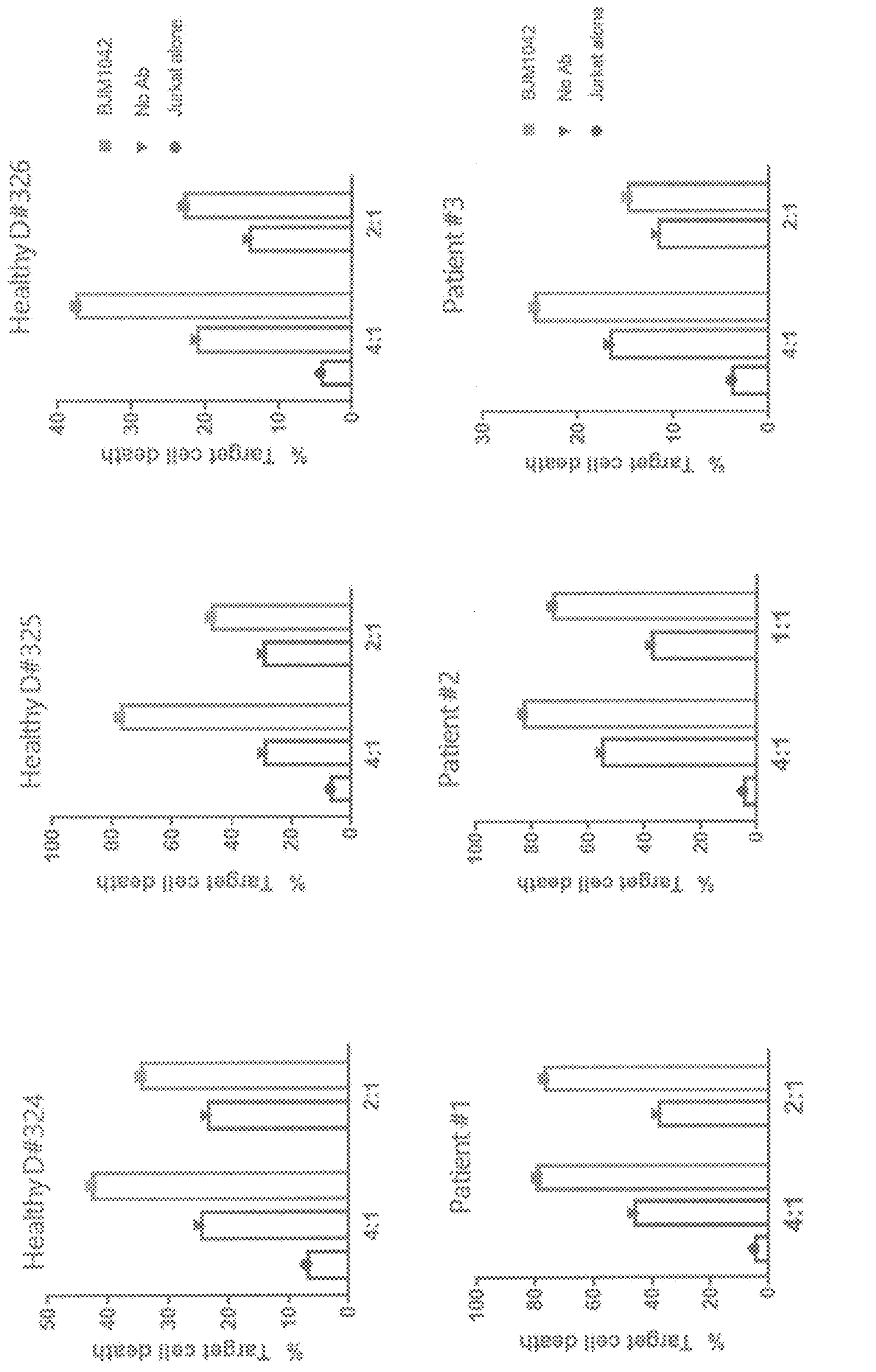
FIG. 23 is a panel of figures showing killing of TRBC1+ Jurkat cells in the presence of the indicated antibodies. The NK cells tested were isolated from healthy donors (upper panel) or from PTCL patients (lower panel).
Figure 24:
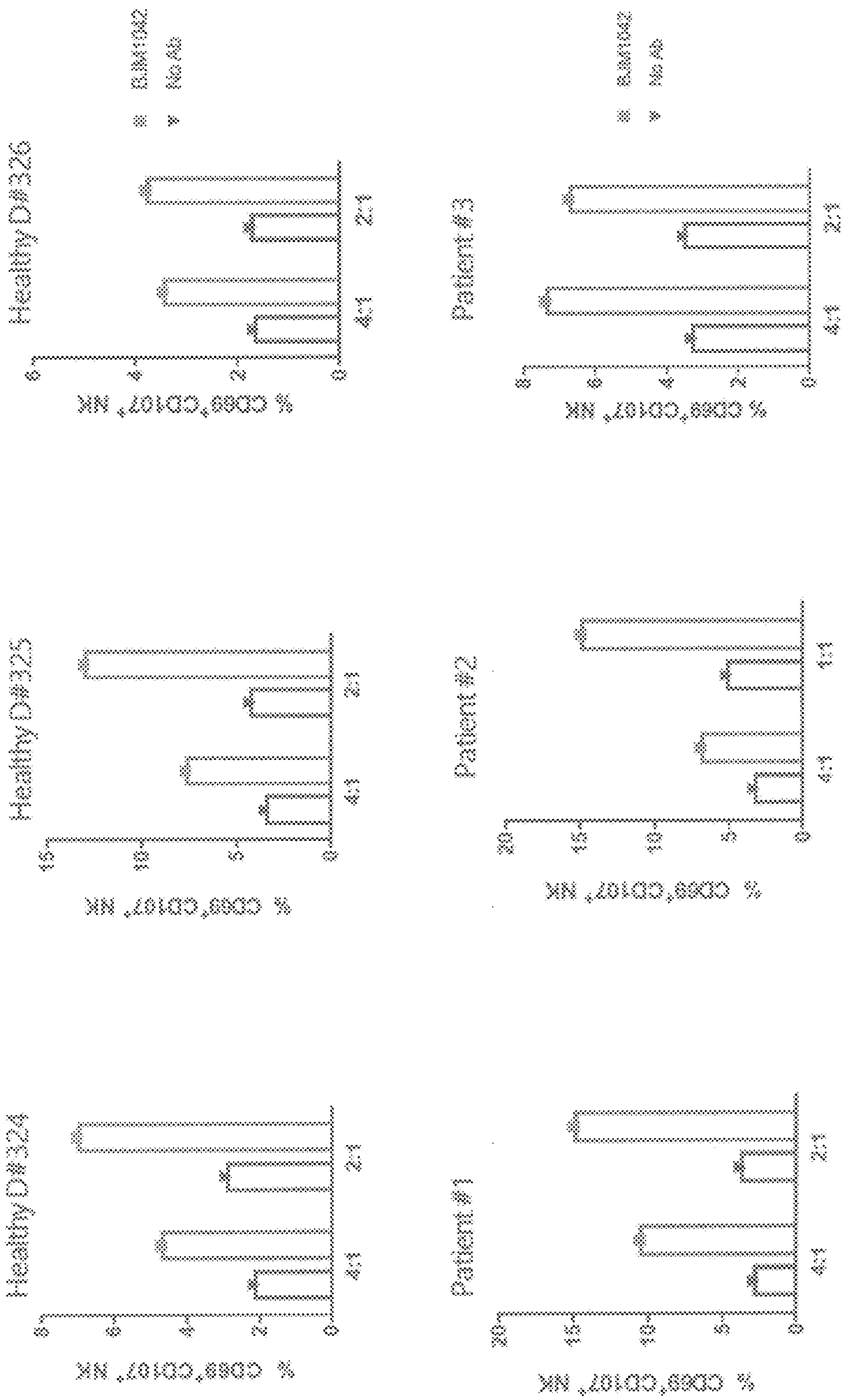
FIG. 24 is a panel of figures showing activation of NK cells during the killing assay shown in FIG. 23. The NK cells tested were isolated from healthy donors (upper panel) or from PTCL patients (lower panel).
Figure 25A:
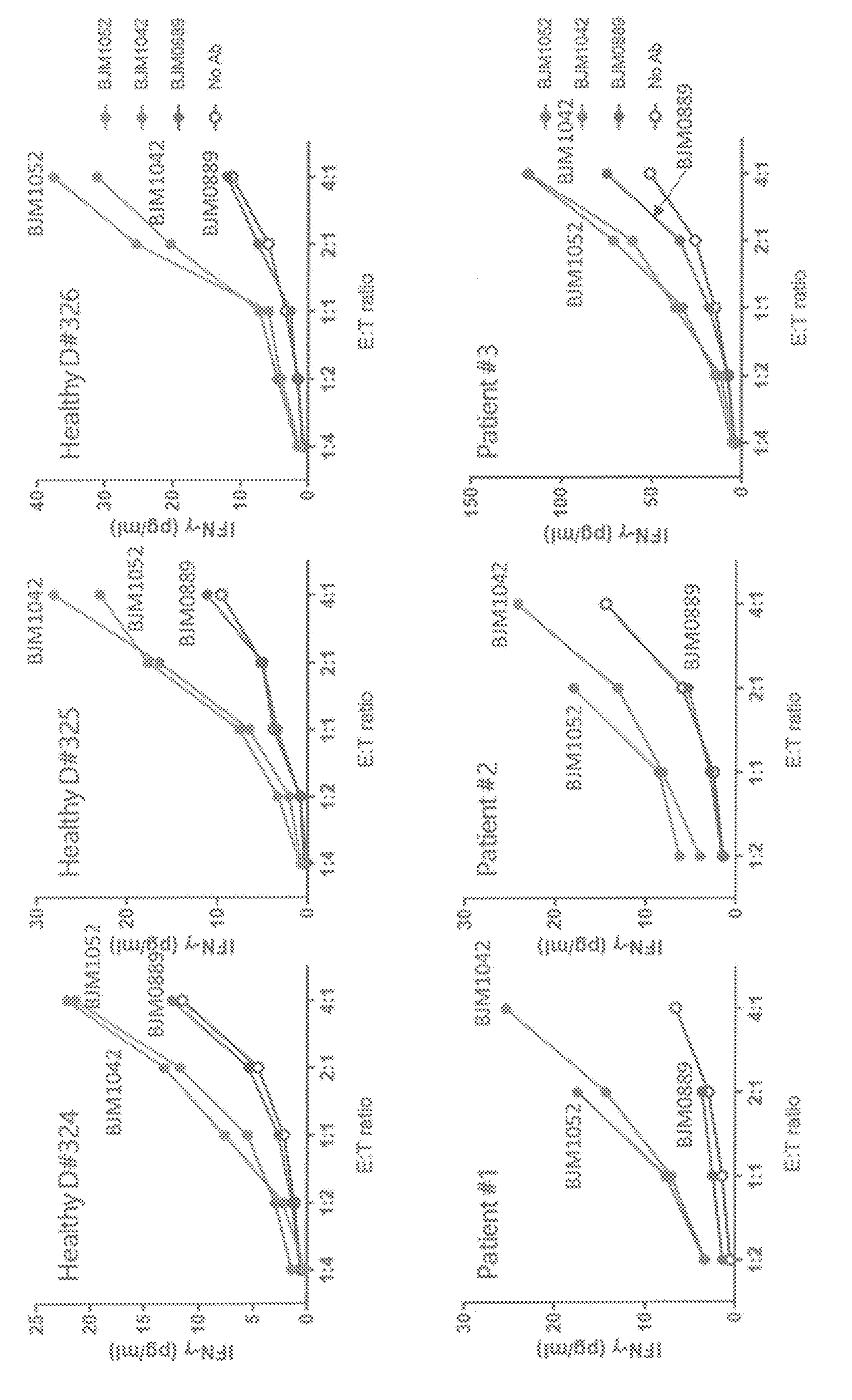
FIGS. 25A and 25B are a panel of figures showing IFNγ (FIG. 25A) or TNFα (FIG. 25B) secretion levels of NK cells when co-cultured with Jurkat cells in the presence of the indicated antibodies. The NK cells tested were isolated from healthy donors (upper panel) or from PTCL patients (lower panel).
Figure 25B:
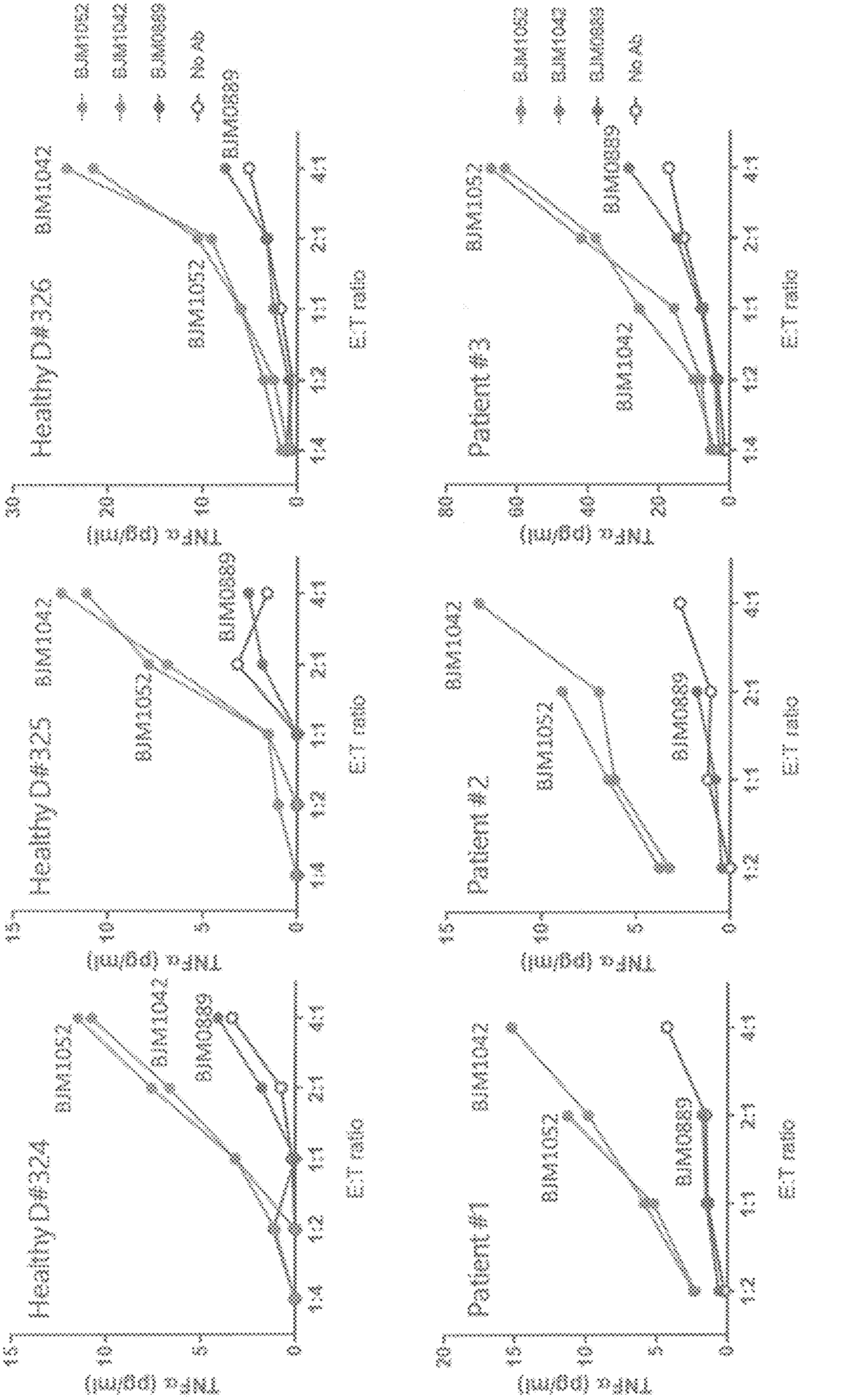

As shown in FIG. 23, PTCL patient derived NK cells killed TRBC1+ Jurkat cells in the presence of the anti-TRBC1/NKp30 antibody BJM1042. NK cells were activated during the killing assay, as demonstrated by the percentage of CD69+CD107+ NK cells (FIG. 24). The bispecific anti-TRBC1/NKp30 antibodies BJM1052 and BJM1042 induced higher levels of IFNγ (FIG. 25A) and TNFα (FIG. 25B) than the single arm anti-TRBC1 antibody FJM0889 did.

Example 14: Competition with B7-H6, a Natural Ligand for NKp30

The natural ligands of NKp30 includes B7-H6, pp65, BAT3, and BAG6. B7-H6 is found on many cancer cell lines and primary cancer cells (e.g., T- and B-cell lymphoma, leukemia, and melanoma). Membrane-bound B7-H6 can mediate activation of primary human NK cells and killing of target cells. Soluble B7-H6, on the other hand, is found in serum or tumor microenvironment and can inhibit binding of anti-NKp30 mAbs, down-modulate NKp30 expression, and dampen NKp30-mediate activation and target cell killing.

This example examines whether the bispecific anti-TRBC1/NKp30 antibodies compete with B7-H6 for binding to NKp30.

Figure 26A:
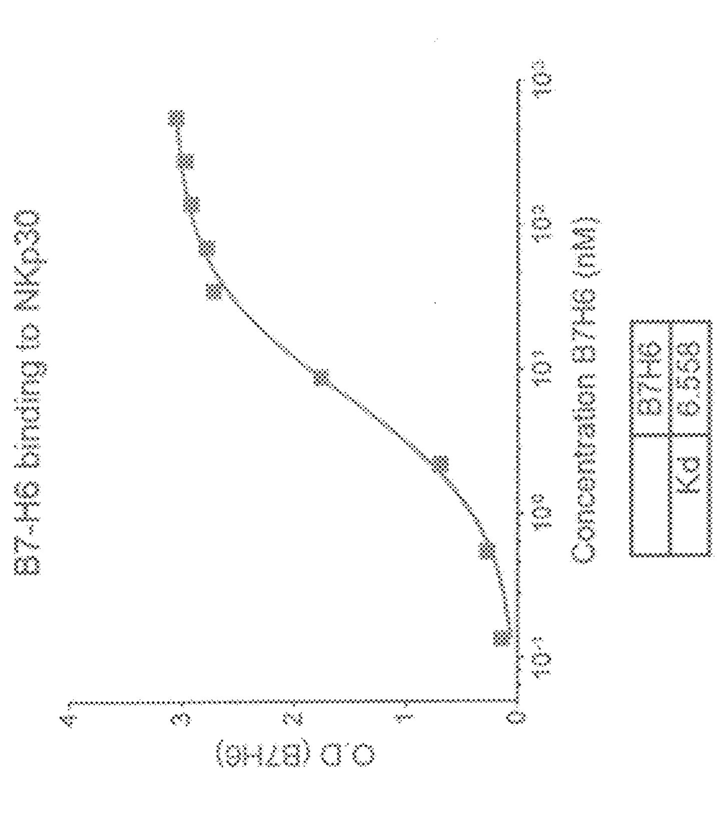
FIGS. 26A-26C are graphs measuring binding to NKp30 in ELISA.
Figure 26B:
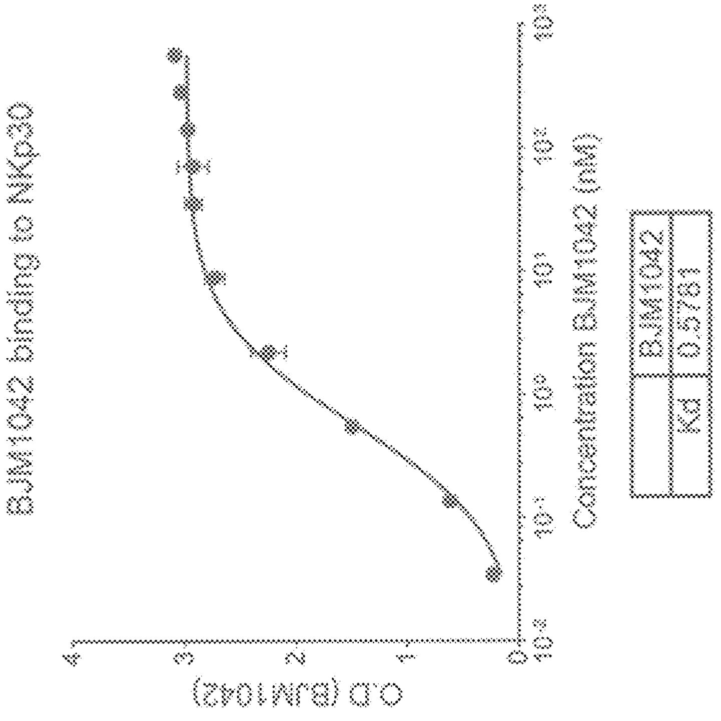
Figure 26C:
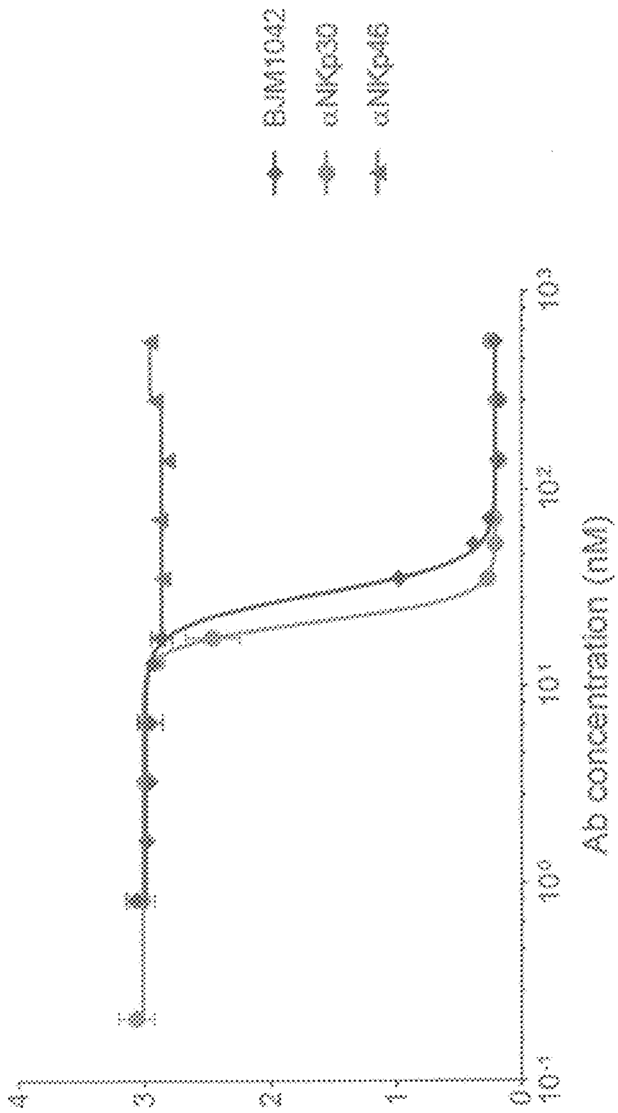

As shown in FIGS. 26A and 26B, the bispecific anti-TRBC1/NKp30 antibody BJM1042 bound more strongly to NKp30 than B7-H6. In a competition assay, B7H6 (4 μg/ml, ~143 nM) and varying concentration of antibodies (BJM1042, anti-NKp30 or anti-NKp46) were added simultaneously to NKp30 coated ELISA plate. As shown in FIG. 26C, B7H6 binding signal was diminished with increasing concentrations of competing antibodies. BJM1042 competed with B7-H6 for binding with NKp30, to a similar level as a positive control anti-NKp30 antibody (FIG. 26C). A negative control anti-NKp46 antibody did not interfere with B7-H6 binding to NKp30, suggesting that the interference observed in this ELISA was specific (FIG. 26C).

Example 15: In-Vivo Killing of TRBC1 Cell Line Derived Model

This example examines the anti-tumor activity of the anti-TRBC1/NKp30 antibody BJM1042 in an in vivo model.

On day 0, NOG-IL-15 mice were implanted subcutaneously with H9 tumor cells. 16 days post tumor implant, mice were engrafted with in vitro expanded primary NK cells. Two weeks following NK implant (31 days post tumor implant), mice were randomized by tumor volume and dosed with 1 mg/kg BIM1042 or associated controls. Tumor volume and body weight was measured daily following exposure to test articles.

Figure 27A:
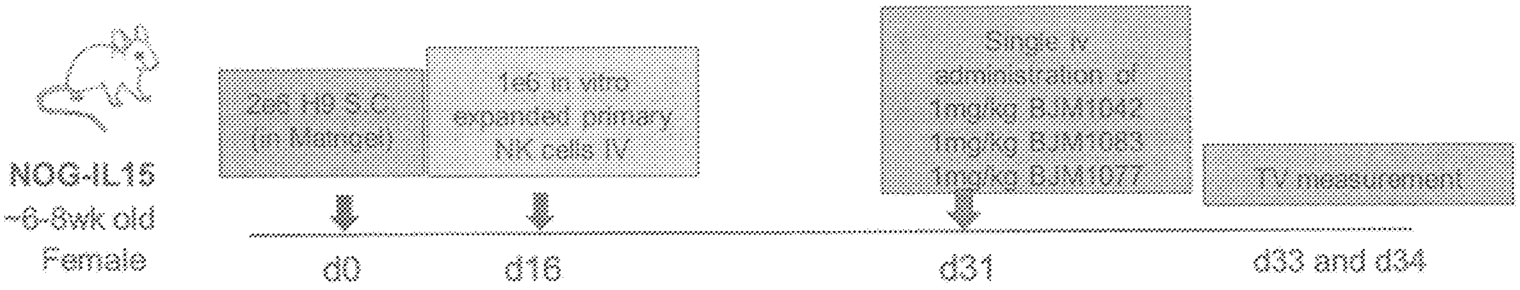
FIGS. 27A-27C are graphs from an in vivo TRBC1+ tumor study.
Figure 27C:
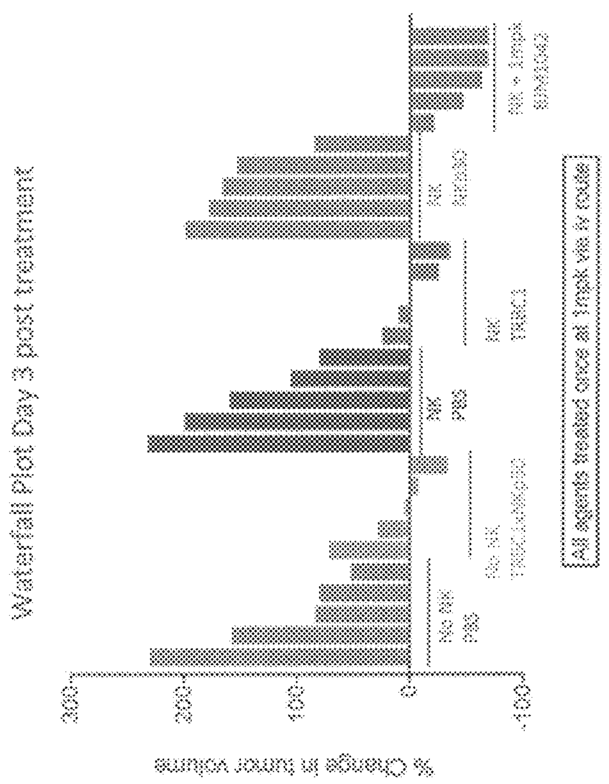
Figure 27B:
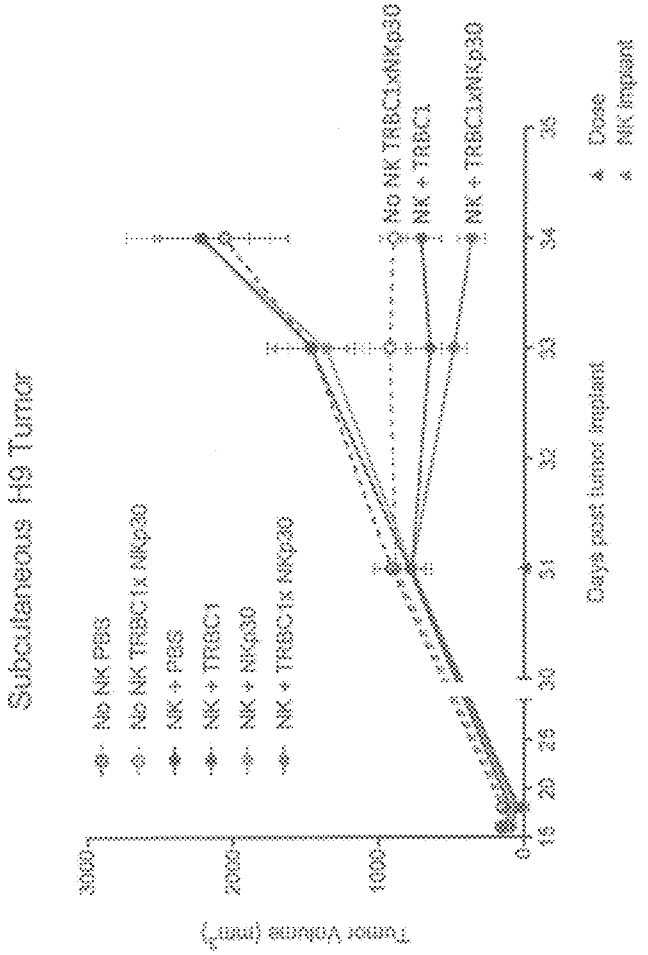

The anti-TRBC1/NKp30 antibody BJM1042 induced regression of subcutaneous H9 tumors in NOG IL-15 mice engrafted with primary NK cells (FIGS. 27B and 27C). BJM1042 also inhibited tumor growth in the absence of NK cells, but to a lesser extent compared to treatment in the presence of NK cells (FIGS. 27B and 27C). Similar results were observed with the anti-TRBC1 control antibody BJM1083 (FIGS. 27B and 27C).

Example 16: In-Vivo Specificity for TRBC1

In this example, the specificity of BJM1042 was evaluated using TRBC2-expressing HPB-ALL xenografts in primary NK cell engrafted NOG-IL-15 mice.

On day 0, NOG-IL-15 mice were implanted subcutaneously with 5e6 TRBC2+ HPB-ALL cells. 12 days post tumor implant, mice were engrafted with 2e6 in vitro expanded primary NK cells. 2 days following NK implant (14 days post tumor implant), mice were randomized by tumor volume and dosed with 0.5 mg/kg BJM1042 or associated controls. Mice were treated with therapeutics twice a week. Tumor volume was quantified by calipers twice a week. Body weight was measured twice a week.

Figure 28A:
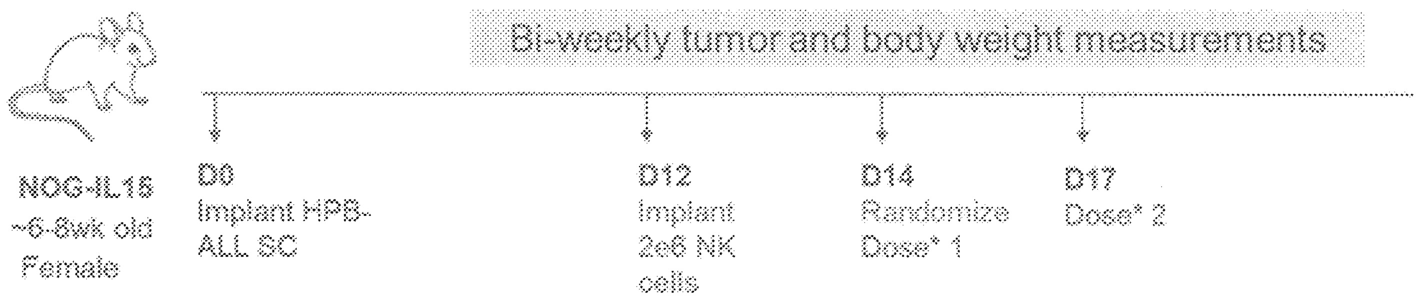
FIGS. 28A and 28B are graphs from an in vivo TRBC2+ tumor study.
Figure 28B:
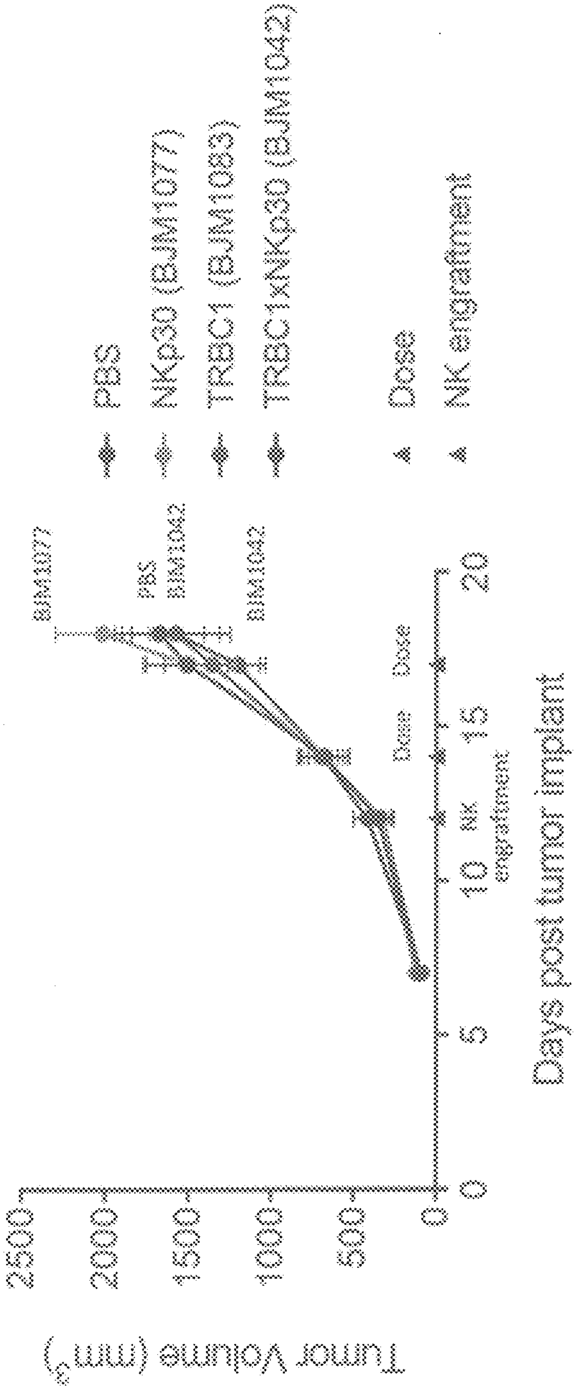

The anti-TRBC1/NKp30 antibody BIM1042, which induced regression of TRBC1-expressing H9 and Jurkat tumors, did not affect the growth of TRBC2-expressing HPB-ALL tumors (FIG. 28B). The molecules were well tolerated at the doses used and did not result in body weight loss or any other obvious adverse effects (data not shown).

Example 17: Biophysical Analysis of Anti-TRBC1/NKp30 Antibodies

The anti-TRBC1/NKp30 antibodies BJM1042 and BJM1052 were analyzed for biophysical properties. BJM1042 and BJM1052 exhibited high stability and low aggregation propensity. BJM1042 and BJM1052 showed retained binding to FcRn and reduced or negligible binding to Fcγ receptors.

Example 18: Biacore Analysis of Exemplary Anti-TRBC1 Antibody Molecules

In this example, a series of exemplary anti-TRBC1 antibody molecules were analyzed for their binding affinity for TRBC1. Briefly, surface plasmon resonance (SPR) measurements were performed by using the BIAcore T200. Each of the exemplary anti-TRBC1 antibody constructs was immobilized on a CM5 chip via anti-human Fc antibody to a response of 50 RU. Human TRBC1 (BIM0443) was injected at concentrations of 15.6, 31.2, 62.5, 125, 250, and 500 nM, at a flow rate of 20 l/min, over the surface on which each antibody construct was immobilized. The data was fit using a 1:1 binding model.

As shown in Table 33, the exemplary antibodies showed preserved affinity to human TRCB1 compared to the parental antibody.

TABLE 33

| Biacore results | | | |
|---|---|---|---|
| Construct | Description | BIM0443 (hTRBC1) | BIM0445 (hTRBC2) |
| BIM0460 (bivalent) | Parental | 10 nM | No binding |
| BJM0578 (bivalent) | Parental | 75 nM | No binding |
| BKM0191 (single arm) | G29A | 75 nM | No binding |
| BKM0192 (single arm) | T31A | 138 nM | No binding |
| BKM0193 (single arm) | G29A T31A | 360 nM | No binding |
| BKM0194 (single arm) | N28G | 180 nM | No binding |
| BKM0195 (single arm) | N30S | 317 nM | No binding |
| BKM0196 (single arm) | N28G N30S | 690 nM | No binding |

Example 19: Biacore Analysis of Exemplary Anti-NKp30 Antibody Molecules

In this example, a series of exemplary anti-NKp30 antibody molecules were analyzed for their binding affinity for NKp30. Briefly, surface plasmon resonance (SPR) measurements were performed by using the BIAcore T200. Human NKp30 (BKM0179) was immobilized on a CM5 chip via anti-mouse Fc antibody to a response of 50 RU. Each exemplary antibody construct were injected at concentrations of 3.9, 7.8, 15.6, 31.2, 62.5, and 125 nM, and at a flow rate of 20 μl/min, over the surface on which the human NKp30 was immobilized. The data was fit using a 1:1 binding model.

As shown in Table 34, most of the exemplary antibodies showed preserved affinity to human NKp30 compared to the parental antibody.

TABLE 34

| Biacore results | | |
|---|---|---|
| Construct | Description | Human Nkp30 (BKM0179) |
| BJM1078 | BJM0407 Parental | 1.48 nM |
| BJM1079 | BJM0411 Parental | 1.26 nM |
| BKM0138 | BJM0411 VL-N95A | 3.2 nM |
| BKM0139 | BJM0411 VL-D92A | 3.2 nM |
| BKM0140 | BJM0407 VL-D92A | 3.3 nM |
| BKM0141 | BJM0407 VL-N95A | 3.0 nM |
| BKM0142 | BJM0411 VH-N60A | 1.28 nM |
| BKM0143 | BJM0407 VH-N60A | 1.45 nM |
| BKM0144 | BJM0411 VH-N60A-VL-D92A-N95A | 6.4 nM |
| BKM0145 | BJM0407 VH-N60A-VL-D92A-N95A | 4.2 nM |

Example 20. Generation of Exemplary Anti-TRBC2 Antibodies

Anti-TRBC1 antibodies were engineered to introduce specificity to TRBC2 using display-based approaches. Through multiple cycles of molecular evolution, anti-TRBC1 antibody was mutated to achieve TRBC2 binding and lose TRBC1 binding. For this purpose, scFv libraries were built using random mutagenesis (1) or a modified version of Kunkel mutagenesis (2). Library selections vs human TRBC2 were performed using standard phage display (3) and yeast display techniques (4). During selections, varying concentrations of competitor unlabeled TRBC1 were added to enrich for mutants that do not bind TRBC1. Selections were followed by standard screening methods such as ELISA and flow cytometry to identify individual clones that bind TRBC2 specifically. Following hit sequencing and analysis of mutation-activity correlation, second-generation libraries were constructed using the same methods above in order to improve specific TRBC2 binding, remove a potential CDR-deamidation site, and humanize the CDRs based on the closest-germline alignment. Library selections and individual clone screening were repeated as above with the modification that more stringent conditions were applied to select for clones with enhanced, but specific TRBC2 affinity. Following hit sequencing, scFv genes were reformatted into the biologically relevant antibody format for expression, purification, and triaging.

Jovi1 binds specifically TRBC1 and not TRBC2. Through 5 iterations of molecular evolution, Jovi1 was mutated to achieve TRBC2 binding and lose TRBC1 binding. For this purpose, a total of 12 scFv libraries were built using random or site-directed mutagenesis. In addition, 2 scFv libraries were constructed using site-directed mutagenesis in order to remove a potential CDR-deamidation site, and humanize the CDRs and frameworks based on the closest-germline alignment. For all libraries, selections versus human TRBC2 were performed using a combination of standard phage display (1) and yeast display techniques (2). During selections, varying concentrations of competitor unlabeled TRBC1 were added to enrich for mutants that do not bind TRBC1. Selections were followed by standard screening methods such as ELISA and flow cytometry to identify individual clones that bind TRBC2 specifically. Following hit sequencing, a panel of 12 scFv genes were reformatted into the biologically relevant antibody format for expression, purification, and triaging. Finally, one of the final hits was mutated at CDRH3 to create a new series of antibodies with different affinities.

Example 21. Binding Specificity of Anti-TRBC2 Mutant Antibodies

Figure 31A:
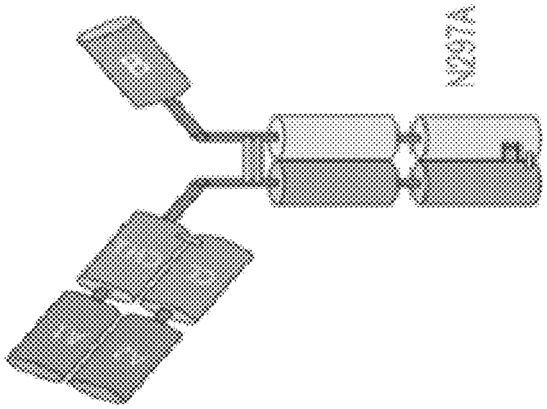
FIGS. 31A and 31B are schematic representations of antibody designs.
Figure 31B:
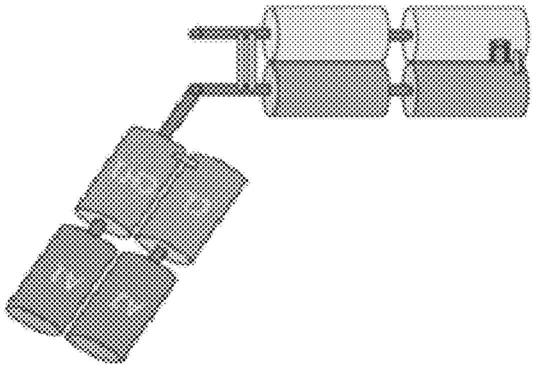

In this example, surface plasmon resonance assay was performed to check binding of anti-TRBC2xNKp30 bispecific antibodies (bispecifics) to either hTRBC2, hTRBC1 or hNKp30 proteins. Some bispecific designs are exhibited in FIGS. 31A and 31B. FIG. 31A shows a bispecific antibody comprising an anti-TRBC2 Fab and an anti-NKp30 scFv. The bispecific antibodies may or may not have an N297A mutation in their Fc regions. FIG. 31B represents a design for monovalent TRBC2 control. Briefly, TRBC2xNKp30 bispecifics at 2 ug/mL were immobilized on CM5 chip via anti-human Fc antibody to 70 RU. Human TRBC2 or human TRBC1 antigens were diluted to 125 nM and then serially diluted two-fold. Association was 300 seconds and dissociation were 600 seconds. This assay was run in 1×HBS-EP+ Buffer pH 7.4 and 25 C. The data was fit using a 1:1 binding model assess binding of bispecifics to NKp30, human NKp30 at 2 ug/mL was immobilized on CM5 chip via Anti-mouse Fc antibody to 70 RU. TRBC2xNKp30 bispecifics were diluted to 50 nM and then serially diluted two-fold. Association was 300 seconds and dissociation were 600 seconds. This assay was run in 1×HBS-EP+ Buffer pH 7.4 and 25 C. The data was fit using a 1:1 binding model.

All TRBC2xNKp30 bispecifics showed specific binding to TRBC2 and NKp30, as shown in Table 35.

TABLE 35

SPR assay results showing hTRBC2, hTRBC1 or hNKp30 proteins by anti-TRBC2x NKp30 bispecifics.

| Construct | hTRBC2 $K_D$ (nM) | hTRBC1 $K_D$ (nM) | hNKp30 $K_D$ (nM) |
|---|---|---|---|
| BKM0098 | 89 | No binding | 0.63 |
| BKM0240 | 28 | No binding | 0.58 |
| BKM0311 | 9.2 | No binding | 0.63 |
| BKM0312 | 31 | No binding | 0.54 |
| BKM0313 | 148 | No binding | NA |
| BKM0314 | 92 | No binding | NA |

Figure 32A:
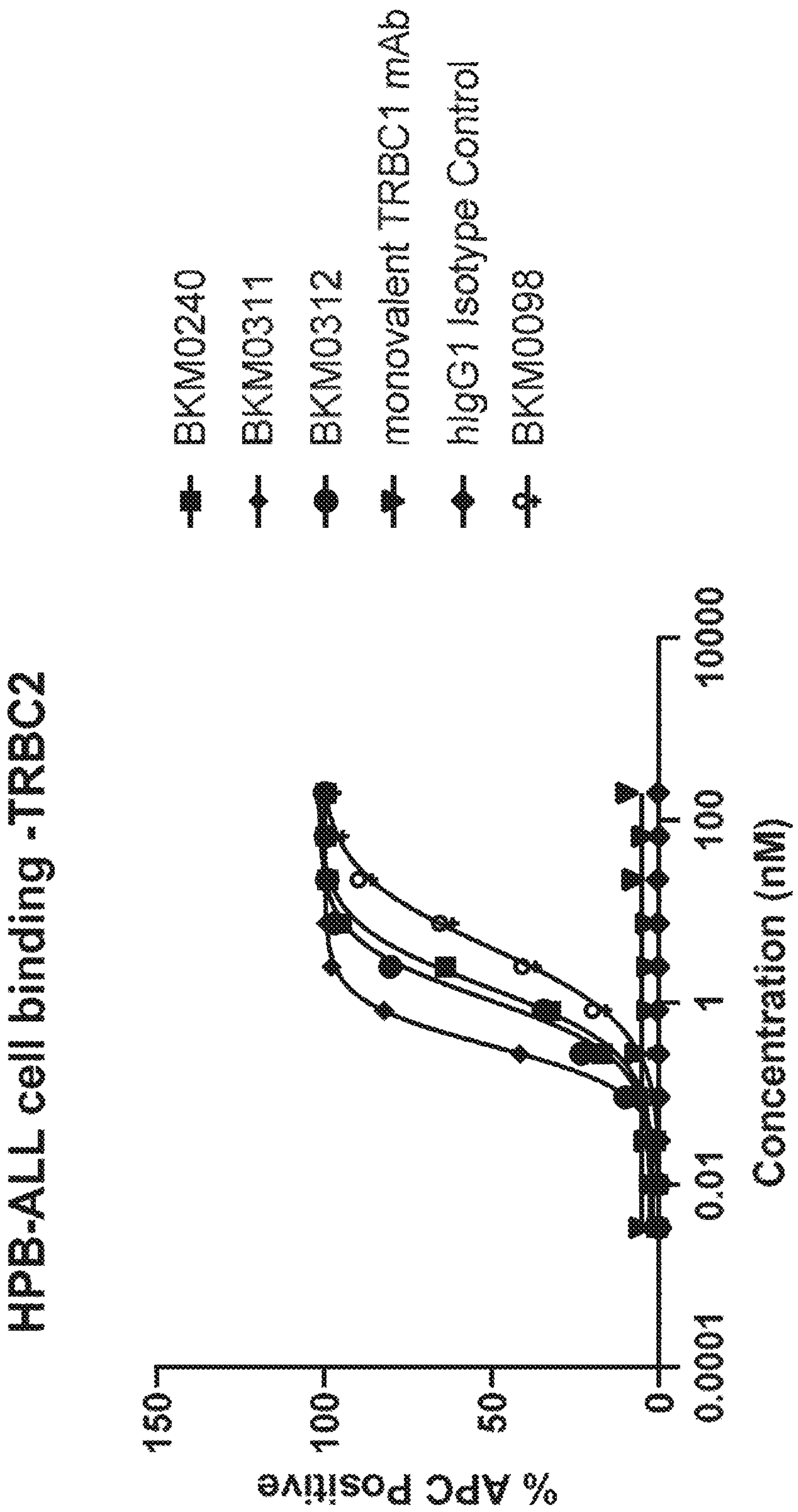
FIGS. 32A-32C are representative data showing selective binding of the anti-TRBC2 antibody to cells expressing either human TRBC2, human TRBC1 or human NK-p30.
Figure 32B:
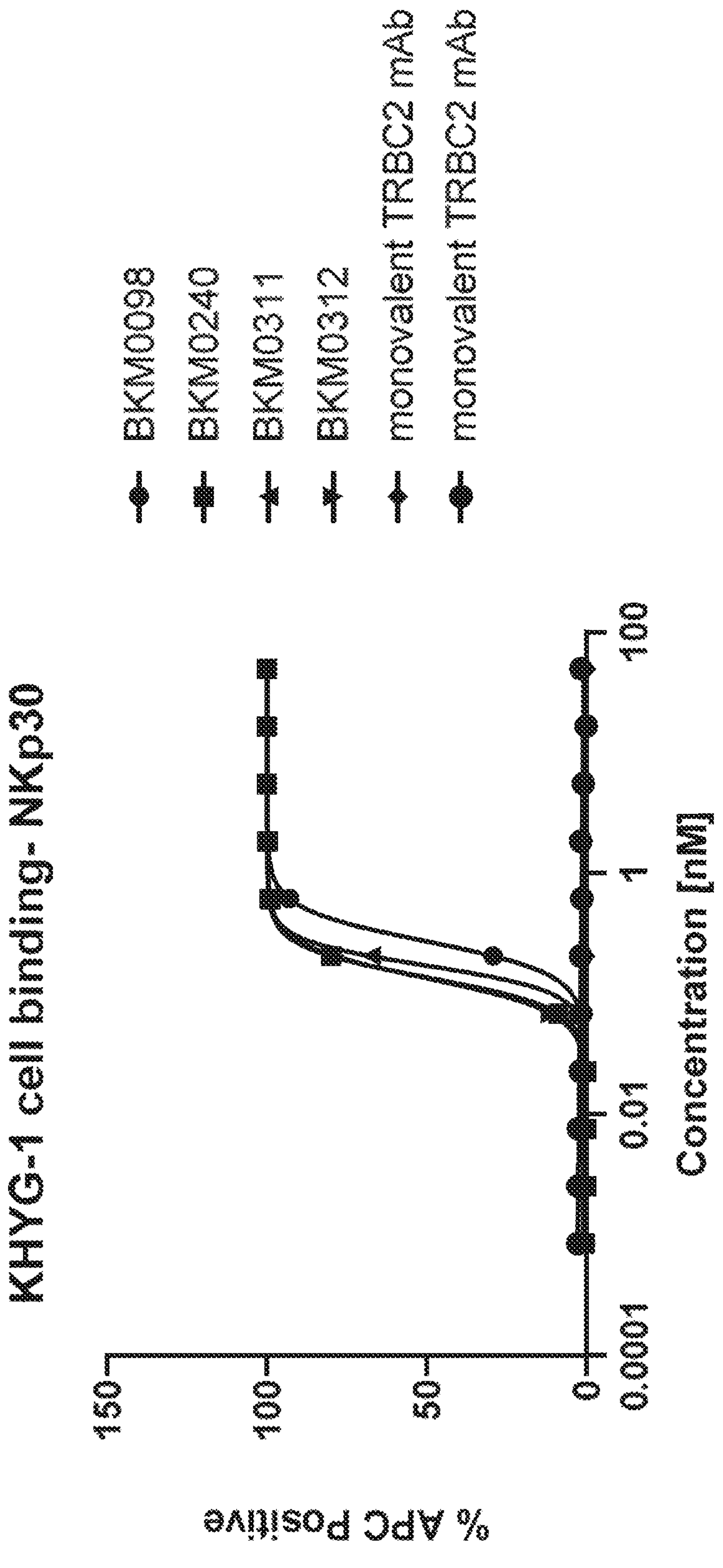
Figure 32C:
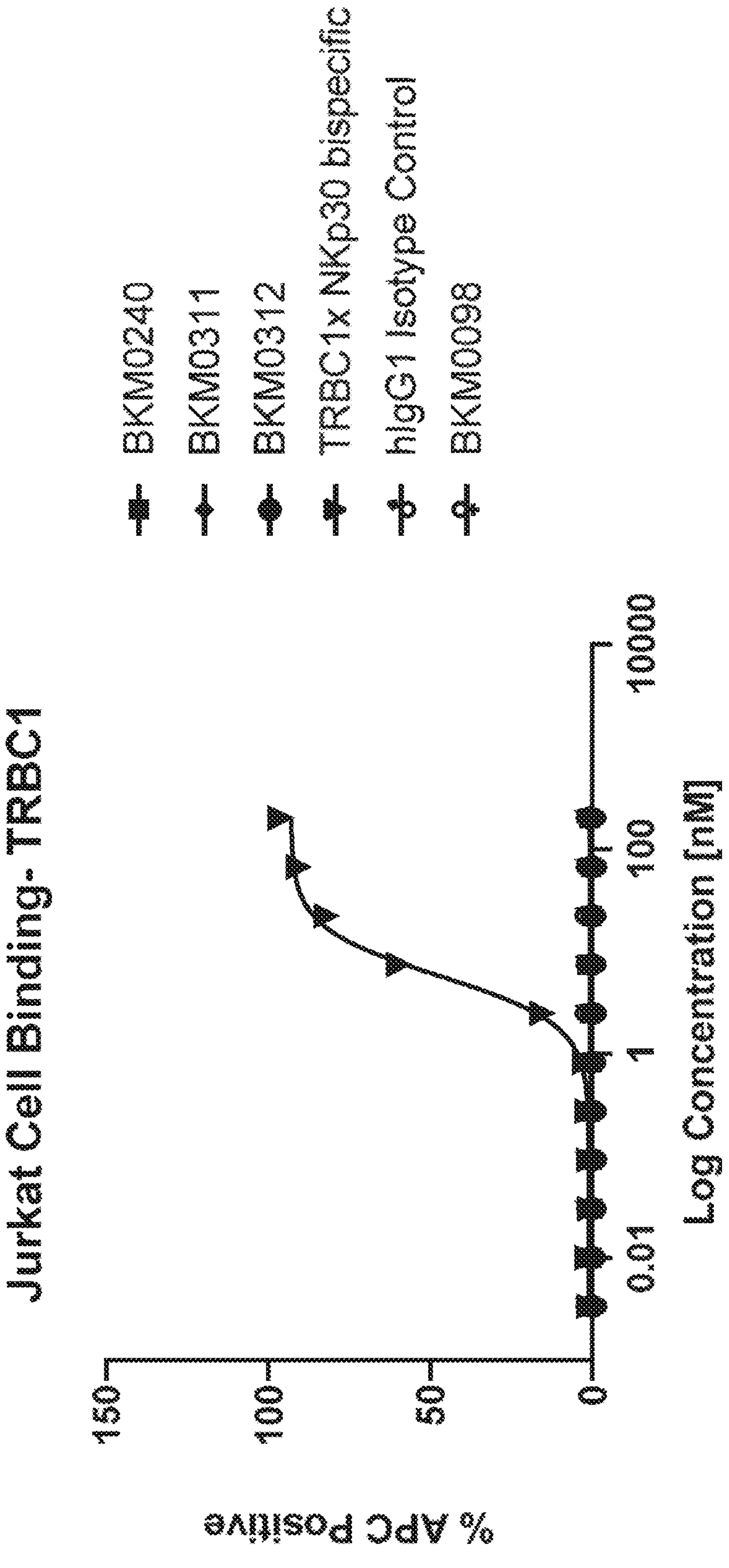

Example 22. TRBC2x NKp30 Bispecifics Selectively Bind to TRBC2+ Cell Lines but not to TRBC1+ Cells A flow cytometry-based assay was performed to check binding of anti-TRBC2x NKp30 to either TRBC2+ HPB-ALL cells, TRBC1+ Jurkat cells or NKp30+ KHYG-1 cells. All the anti-TRBC1/NKp30 bispecifics tested exhibited binding to TRBC2+ HPB-ALL cells (FIG. 32A, Table 36) as well as NK cell line KHYG-1 (FIG. 32B and Table 37), while showing selectivity against TRBC1+ Jurkat cells (FIG. 32C).

TABLE 36

Binding characteristics

| Construct | HPB-ALL cellular binding $EC_{50}$ [nM] |
|---|---|
| BKM0098 | 4.0 |
| BKM0240 | 1.5 |
| BKM0311 | 0.33 |
| BKM0312 | 1.1 |

TABLE 37

Binding characteristics

| Construct | Format | KHYG-1 cellular binding $EC_{50}$ [nM] |
|---|---|---|
| BKM0098 | Parental Bispecific | 4.0 |
| BKM0240 | Parental Bispecific | 1.5 |
| BKM0311 | Bispecific | 0.33 |
| BKM0312 | Bispecific | 1.1 |
| BKM0343 | Monovalent TRBC2 mAb | — |
| BKM0344 | Monovalent TRBC2 mAb | — |

Each antibody was diluted to 200 nM and then serially diluted three-fold down to 0.003387 nM. Antibodies were incubated with each cell line for 1 hour at 4 C. Cells were then incubated with secondary antibody Alexa Fluor 647 Anti-Human IgG (Jackson ImmunoResearch 109-605-098) 1:37.5 for 1 hour at 4 C. Zombie UV (BioLegend 423107) viability dye was added to the cells 1:1000 and incubated for 30 minutes at room temperature. Cells were analyzed on the CytoFlex LX flow cytometer.

Figure 33A:
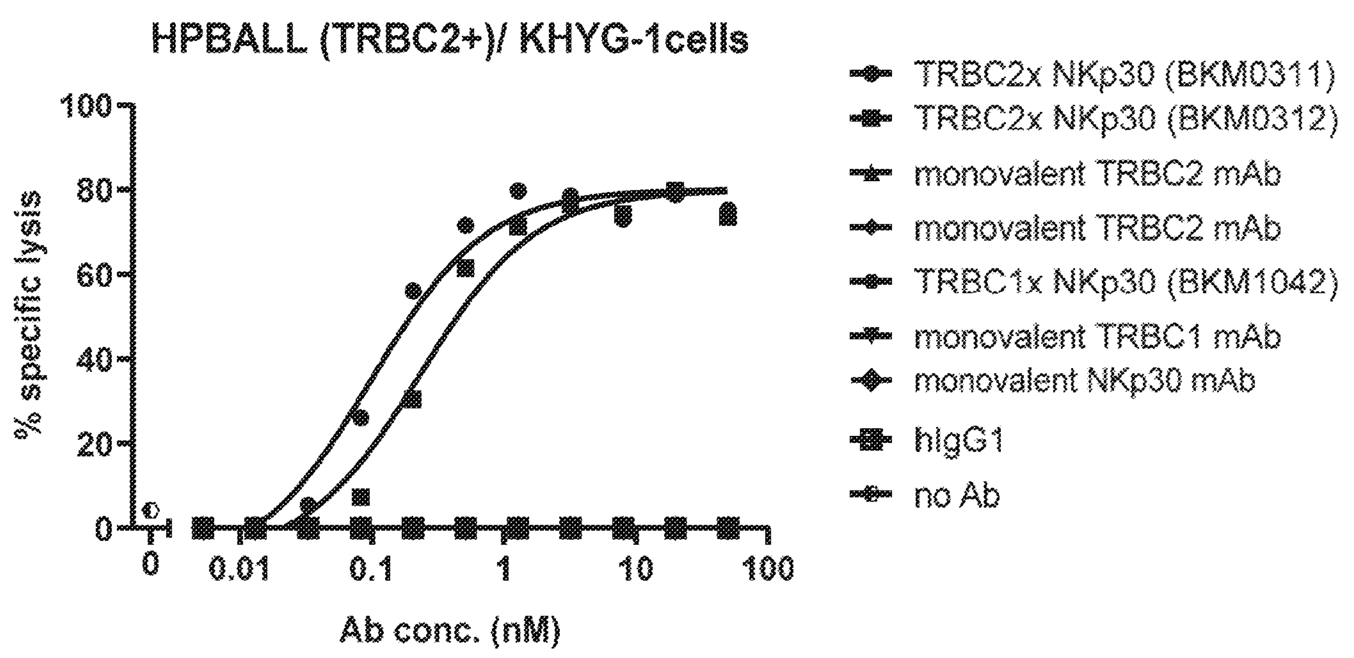
FIGS. 33A-33D are representative data showing selective killing of TRBC2 expressing cell lines (TRBC2+) and not TRBC1 (TRBC1+) expressing cell lines.
Figure 33B:
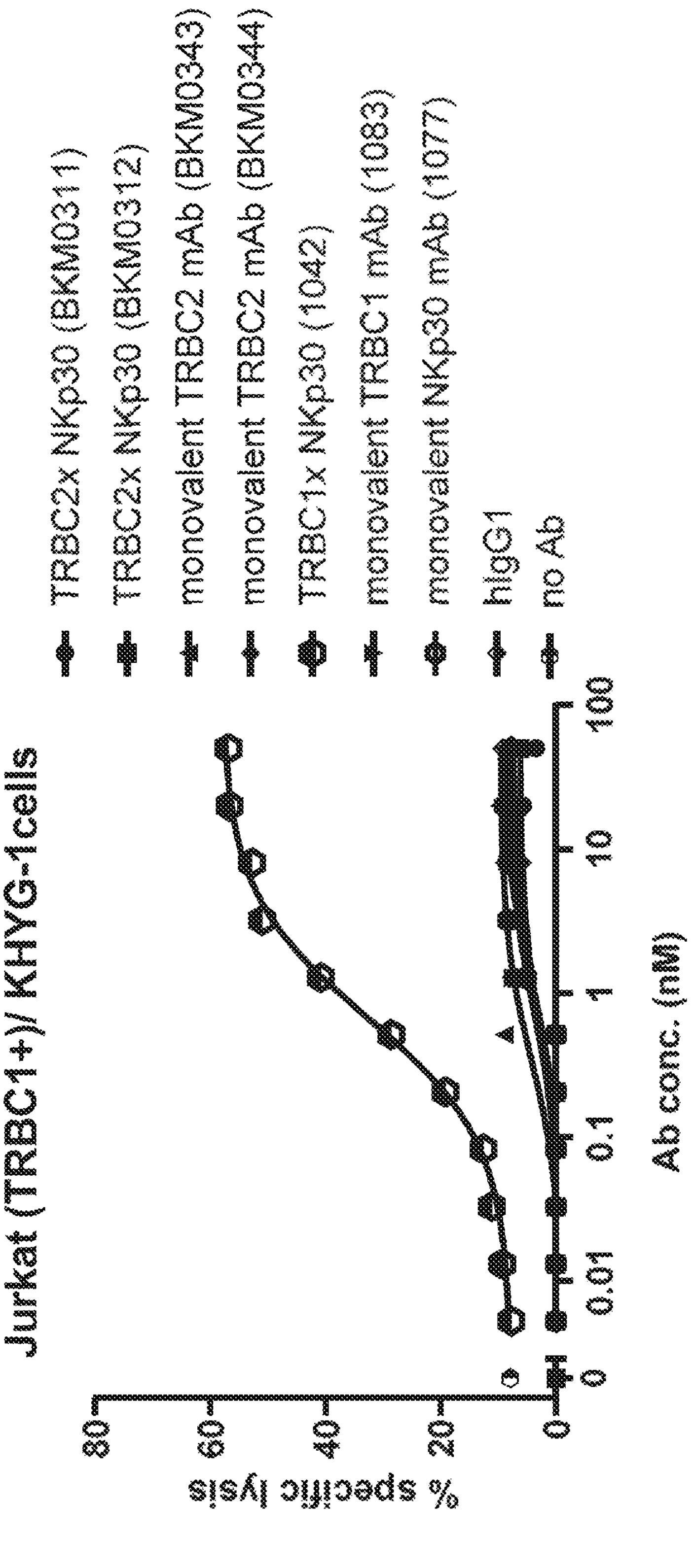

Example 23. TRBC2x NKp30 Bispecifics Selectively Kill TRBC2+ T-NHL Cell Lines but not TRBC1+ Cells In this example, anti-TRBC2/NKp30 mutant antibodies were tested for their ability to induce killing of TRBC2+ malignant cells in the presence of NK effector cells, either KHYG-1 cells or primary human NK cells. KHYG-1 effector cells were cultured in 5:1 ratio with CFSE labeled target HPB-ALL cells for 4h. Target cell lysis was measured using flow cytometry and gating on dead target cells. Anti-TRBC2/NKp30 bispecific antibodies BKM0311 and BKM0312 induced killing of TRBC2+ HPB-ALL cells (FIG. 33A), HH and HDMAR2 cells (Table 38), but not TRBC1+ Jurkat cells (FIG. 33B), in the presence of KHYG-1 effector NK cells. FIG. 33A demonstrates that TRBC2x NKp30 bispecifics selectively kill TRBC2+ HPB-ALL cells with KHYG-1 NK cells as effectors in vitro, with an EC50 of 09821 (BKM0311), and 0.2324 (BKM0312). FIG. 33B demonstrates that TRBC2x NKp30 bispecifics do not kill TRBC1+ Jurkat cells in vitro.

TABLE 38

| Specific lysis of TRBC2+ cells with KHYG-1 cells as effectors | |
|---|---|
| TRBC2+ Cells | EC50 (nM) |
| HPB-ALL | 0.081 |
| HH | 0.618 |
| HDMAR2 | 0.064 |

Figure 33C:
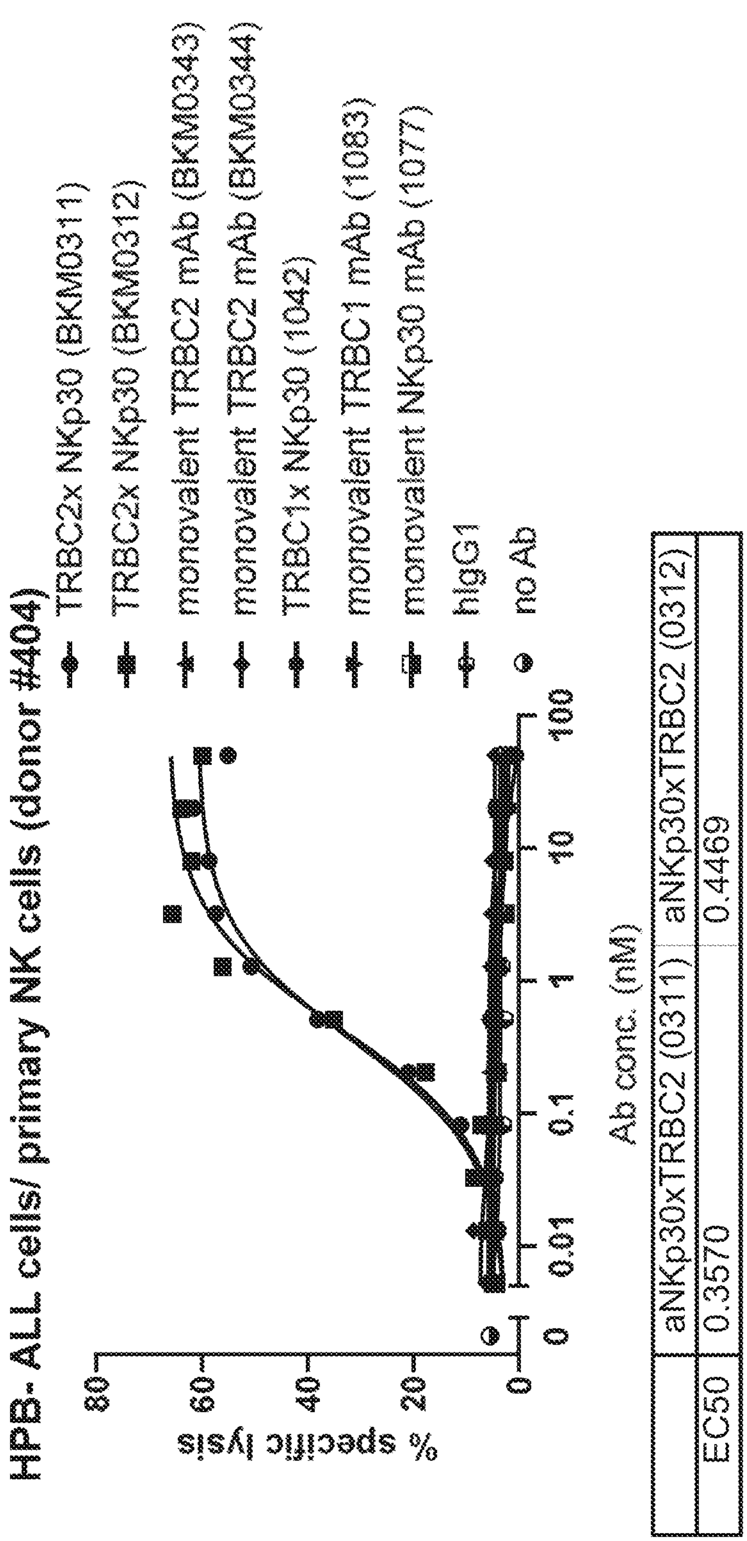
Figure 33D:
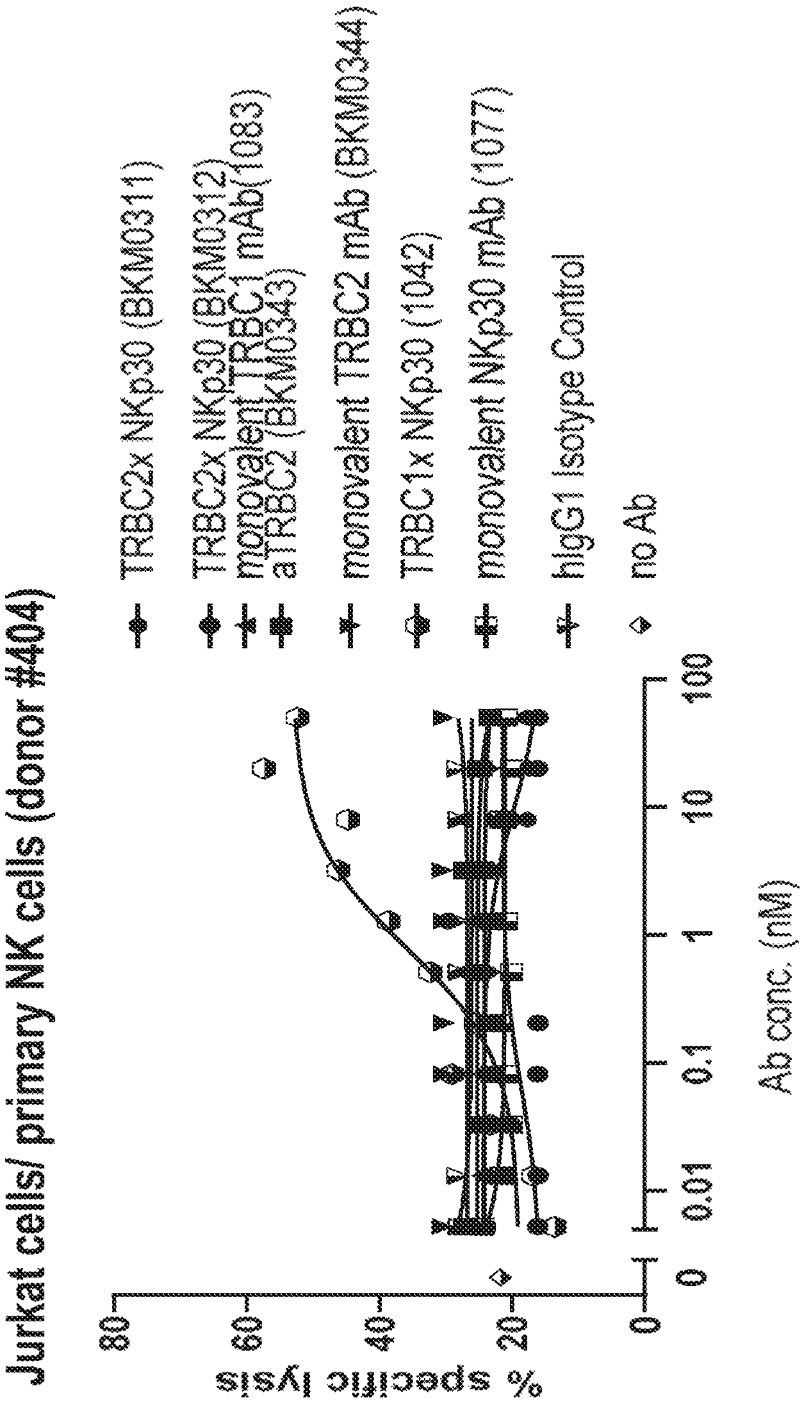

In another study, primary NK cells were cultured in 5:1 ratio with CFSE labeled target HPB-ALL cells for 4h. Target cell lysis was measured using flow cytometry and gating on dead target cells. Anti-TRBC2/NKp30 bispecific antibodies BKM0311 and BKM0312), cocultured with primary NK cells induced killing of TRBC2+ HPB-ALL cells (FIG. 33C), but not TRBC1+ Jurkat cells (FIG. 33D). FIG. 33C demonstrates TRBC2x NKp30 bispecifics selectively kill TRBC2+ HPB-ALL cells with primary NK cells as effectors in vitro EC50 for BKM0311 is 0.3570, and that for BKM0312 is 0.4469. FIG. 33D demonstrates TRBC2x NKp30 bispecifics do not kill TRBC1+ Jurkat cells with primary NK cells in vitro.

Figure 34A:
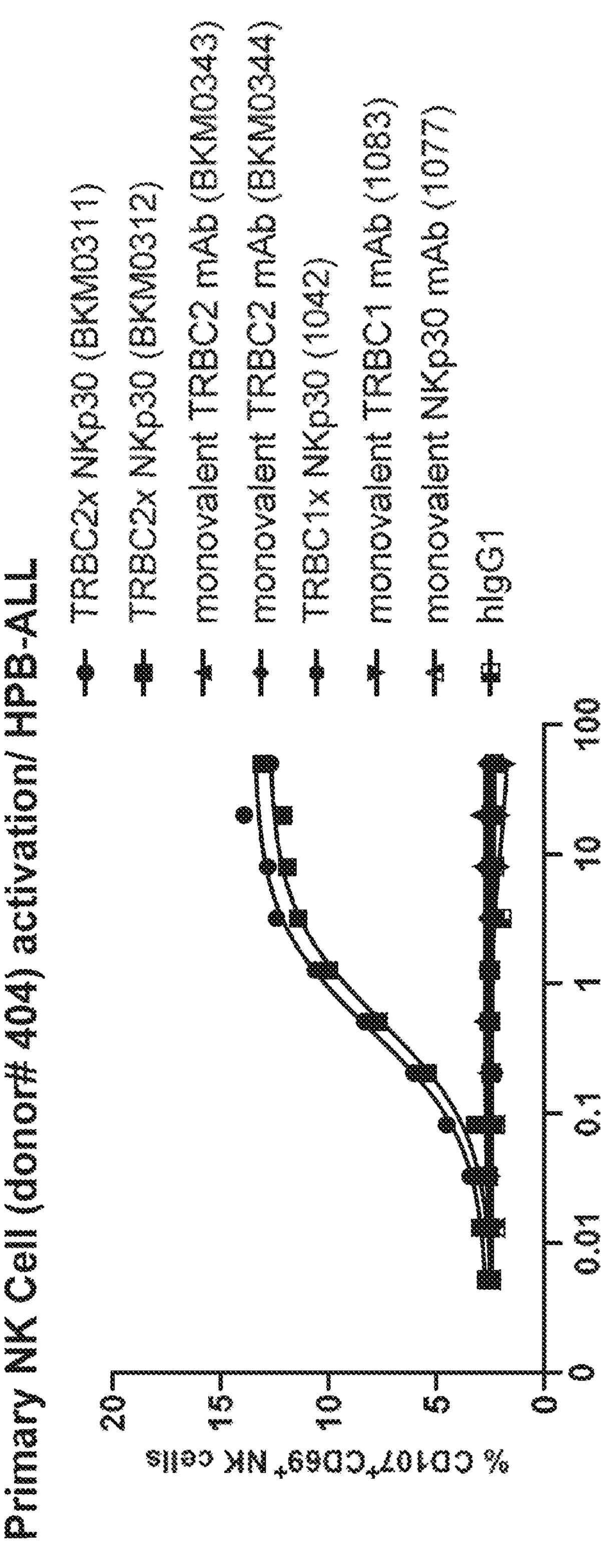
FIGS. 34A and 34B are representative data showing TRBC2xNKp30 bispecifics activate primary NK cells cocultured with TRBC2+ cells in vitro.
Figure 34B:
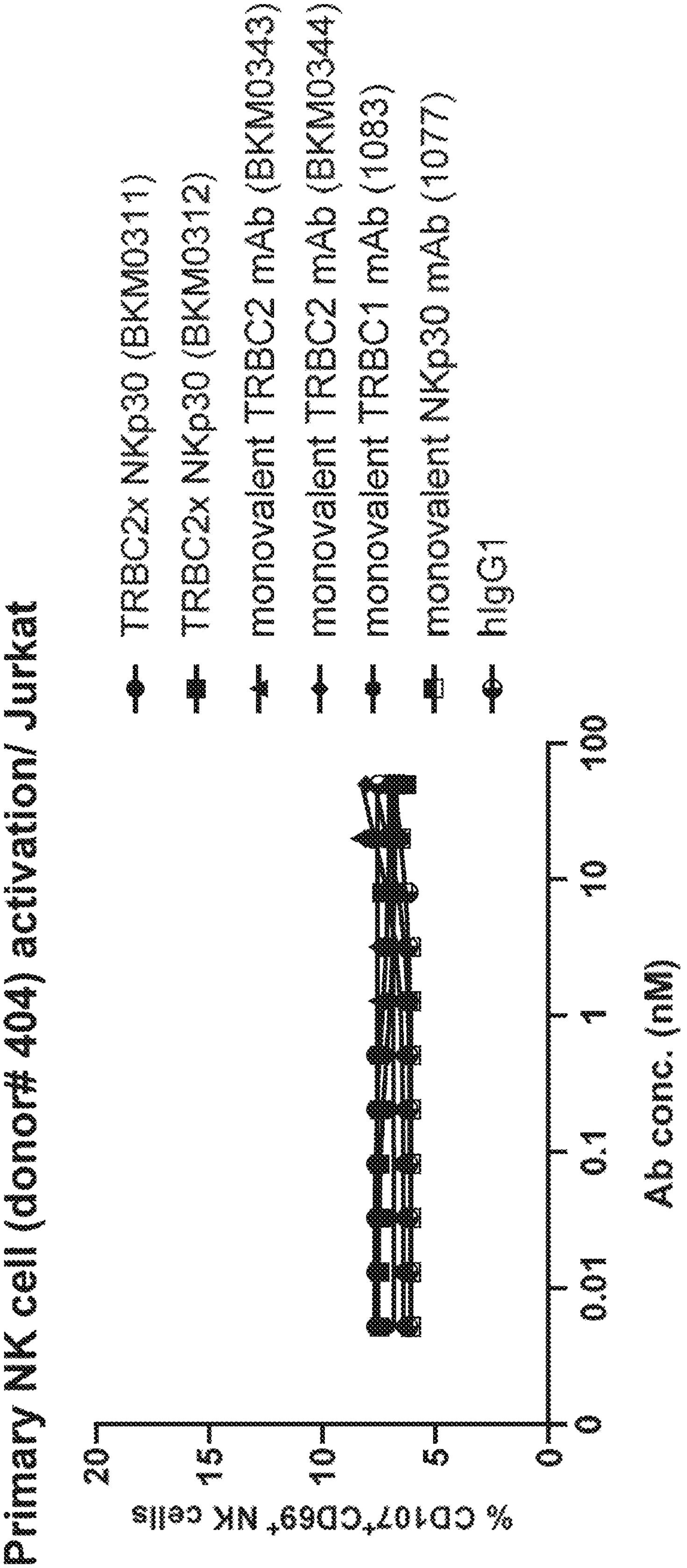

Example 24. TRBC2xNKp30 Bispecifics Activate Primary NK Cells Cocultured with TRBC2+ Cells In Vitro In this example, data are presented that demonstrate that the TRBC2xNKp30 bispecific antibodies activate NK cells in the presence of TRBC2+ cells in vitro. Primary NK cells cocultured either with TRBC2+ HPB-ALL target cells or TRBC1+ Jurkat cells for a duration of 4 hours in the presence of TRBC2/NKp30 bispecific antibodies BKM0311 and BKM0312. NK cell activation, as demonstrated by the percentage of CD69+CD107a+ NK cells were assessed by flow cytometry. Percentage of activated NK cells were increased with TRBC2x NKp30 bispecific treatments and this activation was TRBC2 specific. However, there was no observation of NK cell fratricide (data not shown). FIG. 34A shows primary NK cell activation in cocultures with TRBC2+ HPB-ALL cells. EC50 for BKM0311 was determined to be 0.4397, for BKM0312 was 0.5176. FIG. 34B shows lack of primary NK cell activation in cocultures with TRBC1+ Jurkat cells.

Figure 35A:
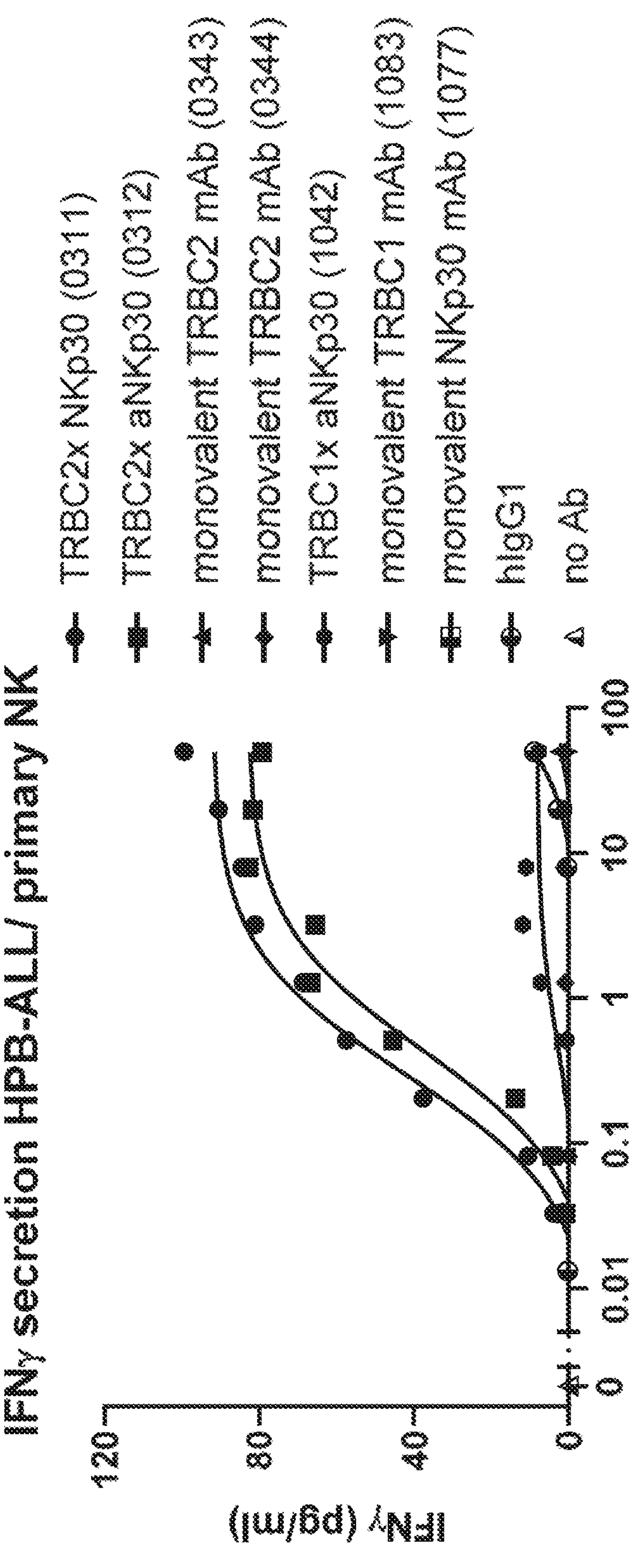
FIGS. 35A-35D are representative data showing TRBC2xNKp30 bispecific antibodies induce secretion of NK activation state relevant cytokines in cocultures of TRBC1+ cells and primary NK cells.
Figure 35B:
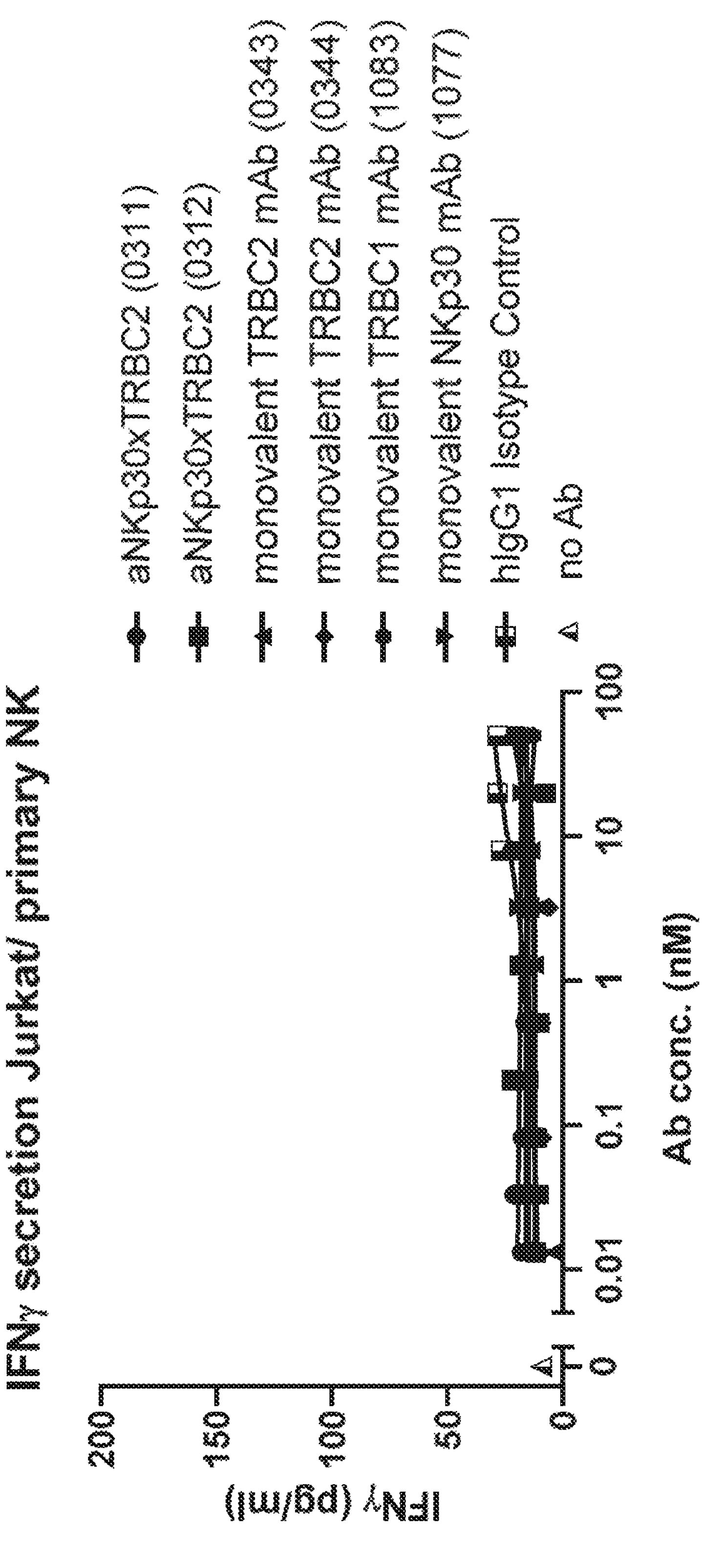
Figure 35C:
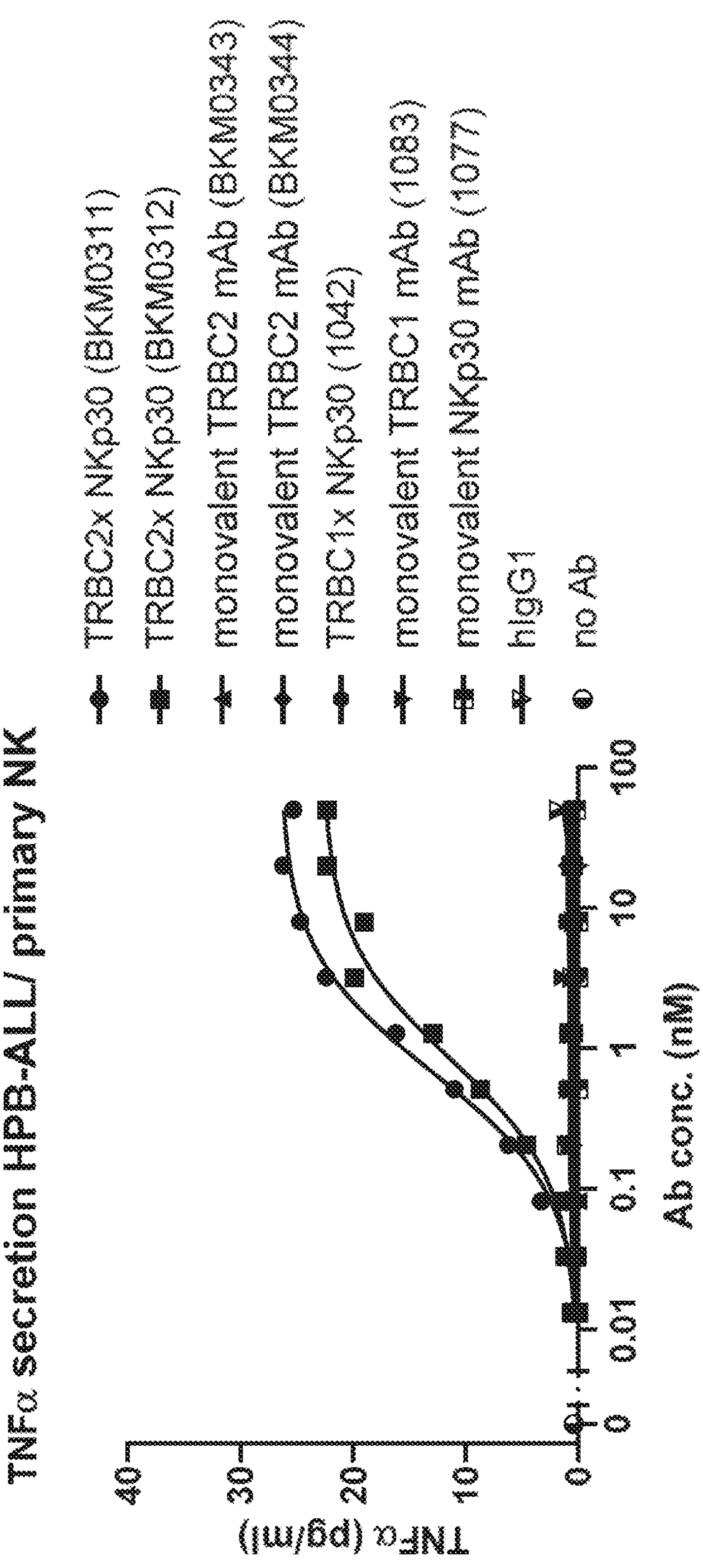
Figure 35D:
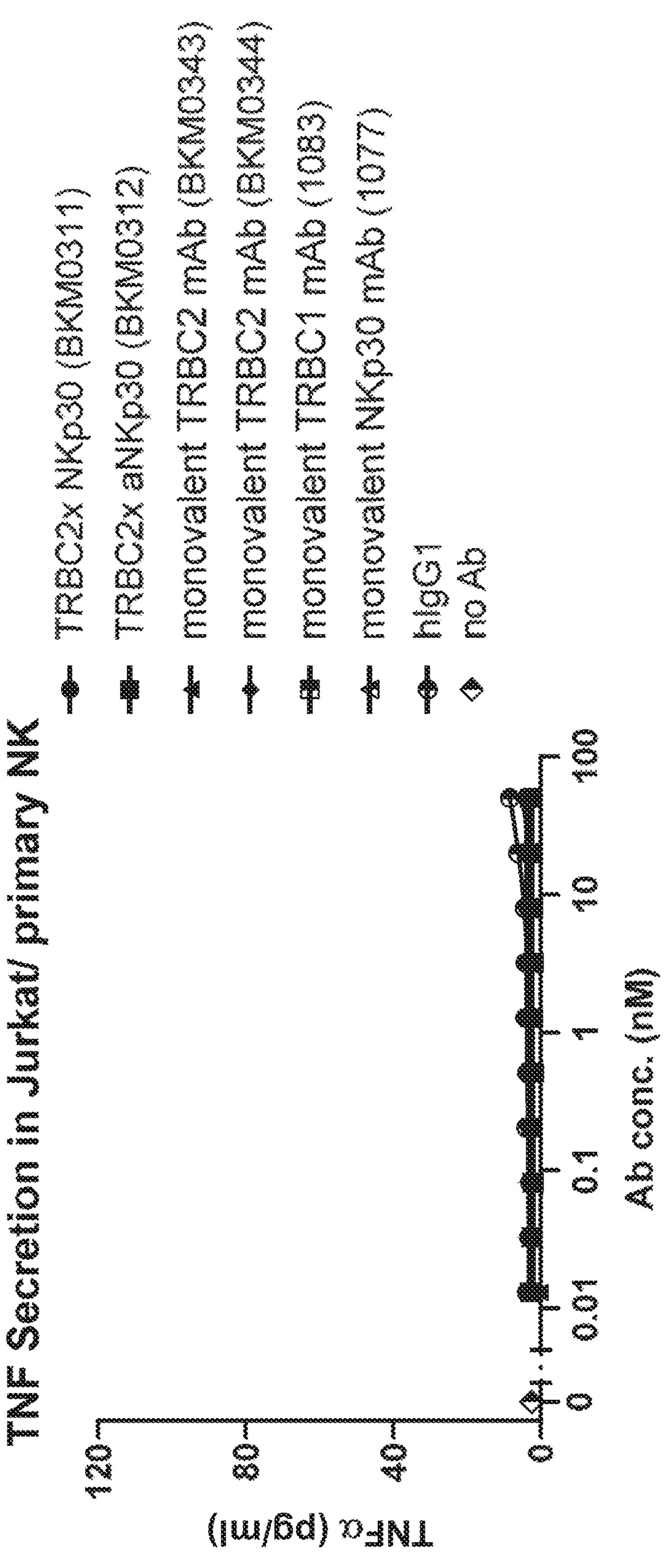

Example 25. TRBC2xNKp30 Bispecific Antibodies Induce Secretion of NK Activation State Relevant Cytokines in Cocultures of TRBC1+ Cells and Primary NK Cells Primary NK cells cocultured either with TRBC2+ HPB-ALL target cells or TRBC1+ Jurkat cells and incubated for 4 hours in the presence of TRBC2/NKp30 bispecific antibodies BKM0311 and BKM0312. Supernatants were then collected, and cytokine levels were measured using MSD. IFNγ (FIG. 35A), and TNFα secretions (FIG. 35C) were noted to be increased with TRBC2x NKp30 bispecific treatments and were correlated with NK cell activation and HPB-ALL target cell lysis. IFNγ secretion (FIG. 35B) and TNFα secretions (FIG. 35D) were TRBC2 specific. In another study the ability of anti-TRBC2x NKp30 bispecifics BKM0311 and BKM0312 to activate NK cells in the absence of target cells was tested. Primary NK cells were incubated with 50 nM of antibodies for 4h in the absence of target cells, and then supernatants were collected to measure IFNγ and TNFα levels. NK cell activation mediated by anti-TRBC2/NKp30 antibodies required the presence of both NK cells and target cells (data not shown) and anti-TRBC2/NKp30 bispecifics BKM0311 and BKM0312 did not induce NK cell death in the presence of target cells (data not shown).

Example 26. TRBC2xNKp30 Bispecific Antibodies Specifically Target Killing of TRBC2+ T-Cell Lymphoma-PDX Samples In PBMCs isolated from healthy donors and diverse subtypes of T-NHL patients, comparable frequency and expression of TRBC2 was observed (data not shown). Two Patient-Derived Xenograft (PDX) samples were tested to be TRBC2 positive: PDX2 was derived from a patient with Adult T-cell Leukemia/Lymphoma (ATLL), and PDX5 was derived from a patient with Hepatosplenic T-cell Lymphoma (HTCL). TRBC1+ PDX3 derived from a patient with Adult T-cell Leukemia/Lymphoma (ATLL) was used as a negative control.

PDX samples were labeled with CFSE, cultured with primary NK cells or KHYG1 cells at 5:1 ratio of E:T for 4 hours in the presence of BKM0311 and BKM0312 (0.01-100 nM). Specific killing was measured using the following calculation:

% dead treated (PDX+NK)−% dead PDX

100% (Max killing)−% dead PDX

Figure 36A:
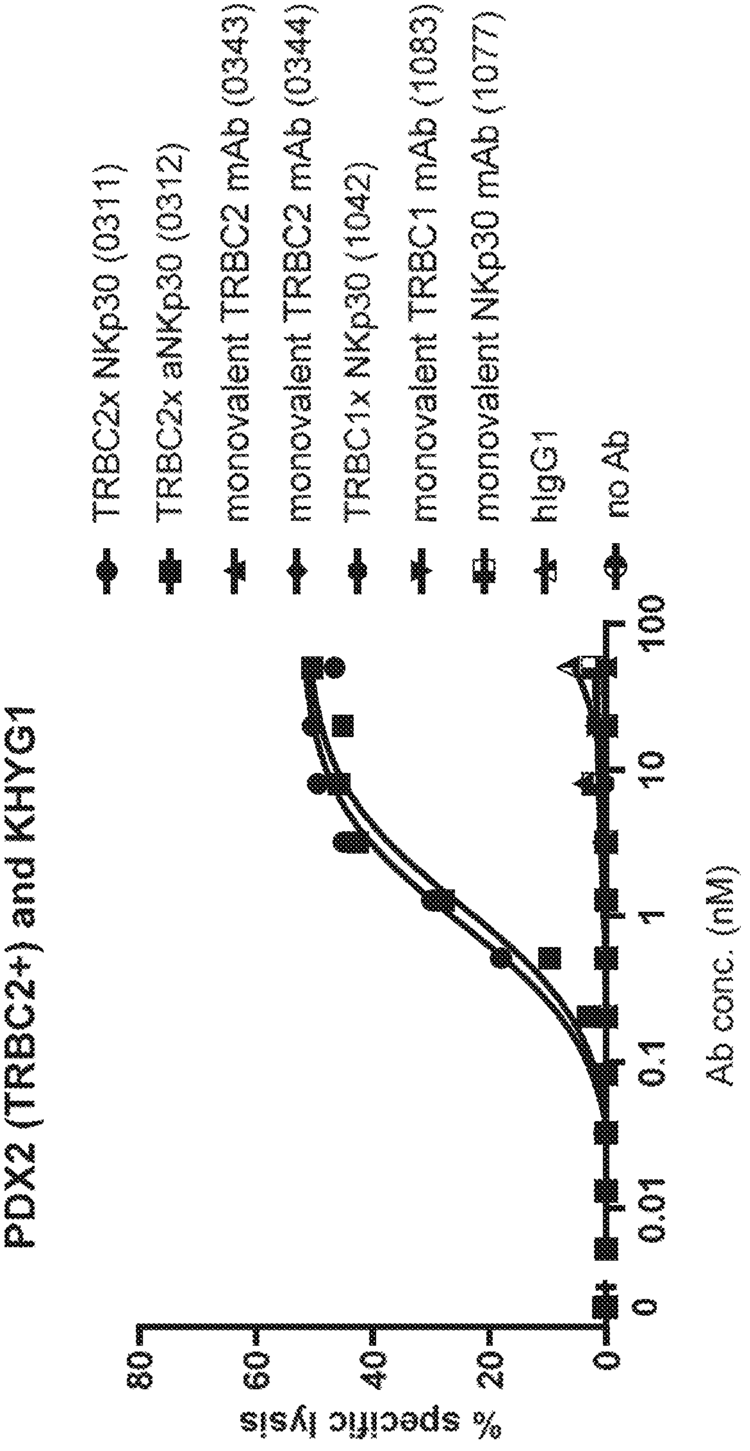
FIGS. 36A-36C are representative data showing targeted killing of patient derived xenograft cells by TRBC2xNKp30 bispecific antibodies.
Figure 36B:
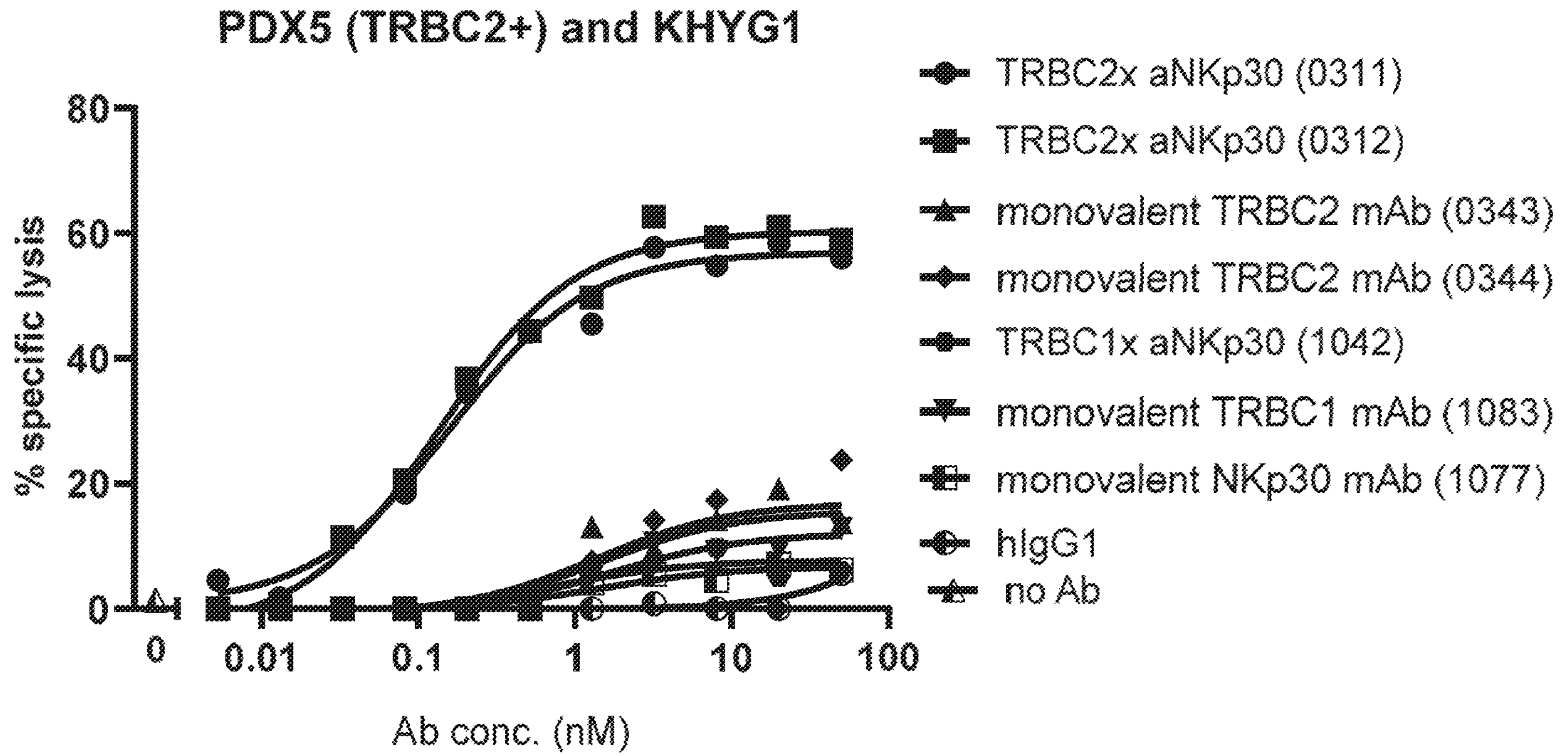
Figure 36C:
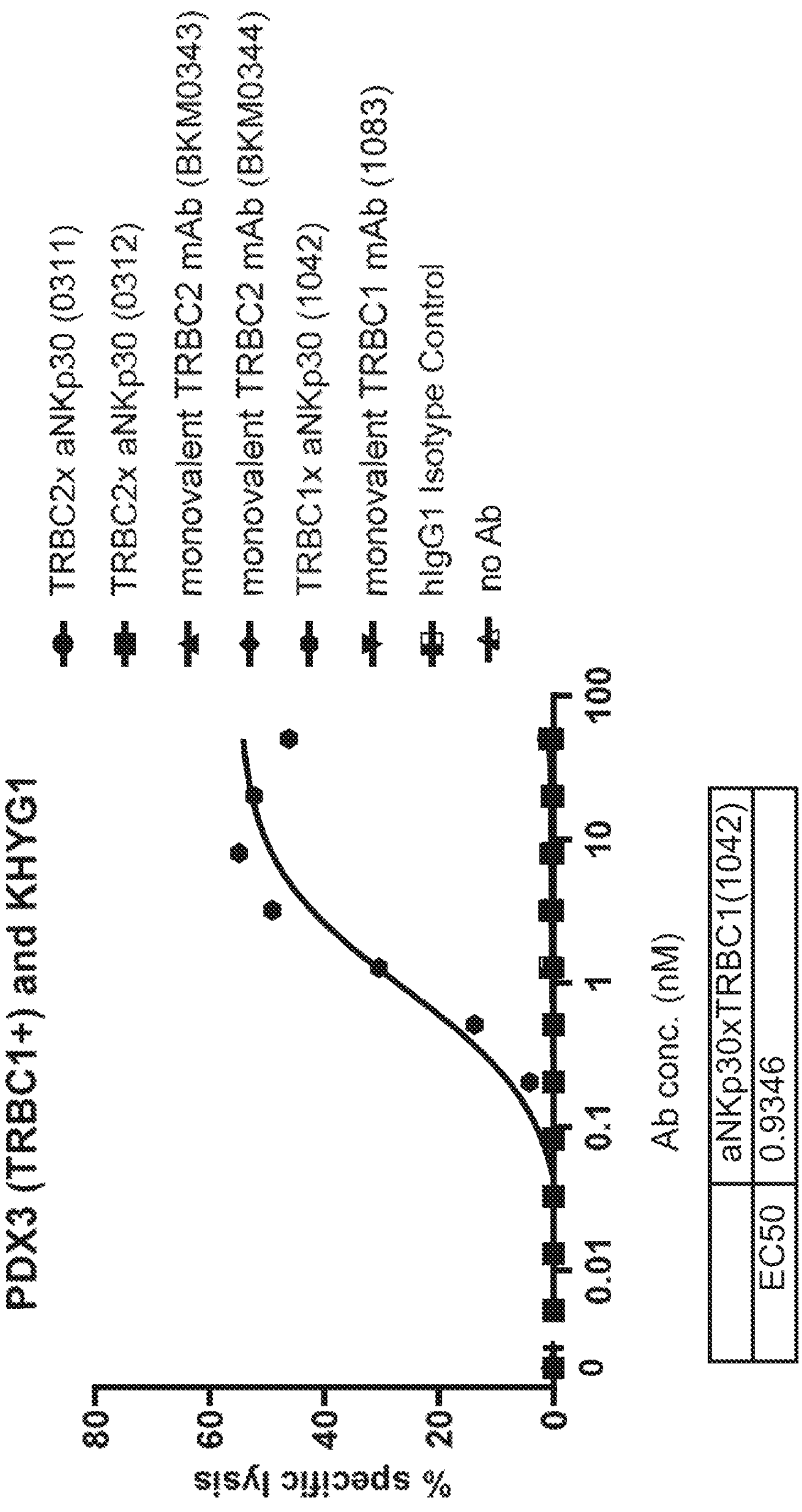

TRBC2x NKp30 bispecifics BKM0311 and BKM0312 were tested in a flow cytometry-based functional cell killing assay in PDXs cocultured with CD16 deficient NK, KHYG-1 cells or primary NK cells. As shown in (FIGS. 36A, and 36B) anti-TRBC2x NKp30 bispecifics BKM0311 and BKM0312, efficiently and specifically killed TRBC2+ PDX samples (FIGS. 36A and 36B) while showing no activity against TRBC1+ PDX3 sample (FIG. 36C). Similar activity of BKM0311 and BKM0312 was noted when primary NK cells were used as effectors in place of KHYG-1 cells (data not shown). The single arm anti-TRBC2 antibodies BKM0343 and BKM0344, did not kill TRBC2+PDX samples, suggesting a significant role for the NKp30 arm of the bispecific.

Example 27. Specific Depletion TRBC1+Vs TRBC2+T Cells from Human PBMCs Using Either TRBC1x NKp30 or TRBC2x NKp30 Bispecific Antibodies In Vitro In this example, selectivity of the TRBC1 and TRBC2 antibody in the bispecific constructs were tested in vitro. Healthy human donor PBMCs derived T cell populations contain both TRBC1+ and TRBC2+ compartments, whereas T cell malignancies are predominantly monotypic.

Figure 37:
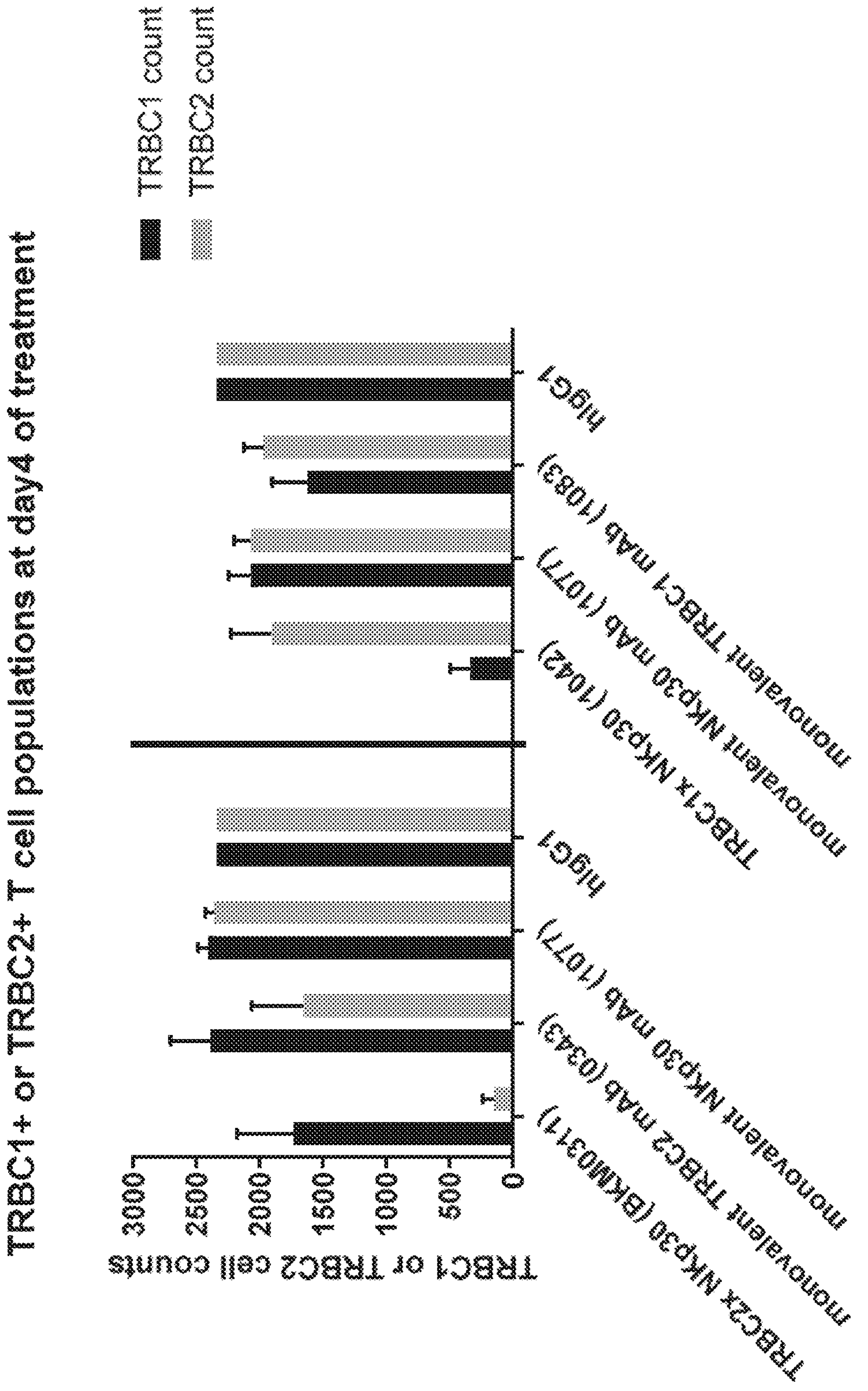
FIG. 37 is representative data showing specific deletion of TRBC1+ vs TRBC2+ T cells from human PBMCs using target specific bispecific antibodies as indicated in the figure. Data was collected at 4 days after treatment.

An in vitro assay system utilizing human PBMCs has been applied where in healthy donor PBMCs treated either with 10 nM anti-NKp30xTRBC1 or 10 nM anti-NKp30xTRBC2 bispecific antibody constructs for 96 h (day4) and assessed by flow cytometry, utilizing flow panel with proprietary TRBC1 and TRBC2 detection antibodies. FIG. 37 shows that the TRBC2x NKp30 specifically depletes TRBC2+ population of T cells while sparing the TRBC1+ population, while TRBC1x NKp30 specifically depletes TRBC1+ population of T cells while sparing the TRBC+ population. The effects of these agents were both time and dose dependent (data not shown).

Example 28. Specific Depletion TRBC1+ Vs TRBC2+ T Cells from Human PBMCs Using Either TRBC1x NKp30 or TRBC2x NKp30 Bispecific Antibodies In Vivo In this example, selectivity of the TRBC1 and TRBC2 antibody in the bispecific constructs were tested in vivo. All animal work was performed at CRADL Vivarium (Cambridge, MA) and compliant with IACUC approved protocols. NSG mice were obtained from JAX Laboratories and NOG-IL-15 mice were sourced from Taconic Biosciences.

For the PD analysis, NOD-scid IL2Rg null (NSG) mice were implanted with 20 million hPBMCs on day0 and treated with 1 ug/mouse IL-15 on day 0, day3 and day6 to retain NK cell function in vivo. The mice were then treated with either anti-TRBC1x NKp30 or anti-TRBC2x NKp30 at doses of 1 mg/kg or 3 mg/kg via intravenous (iv) route at day3 and day6 and whole blood was harvested on day 7.

Figure 38:
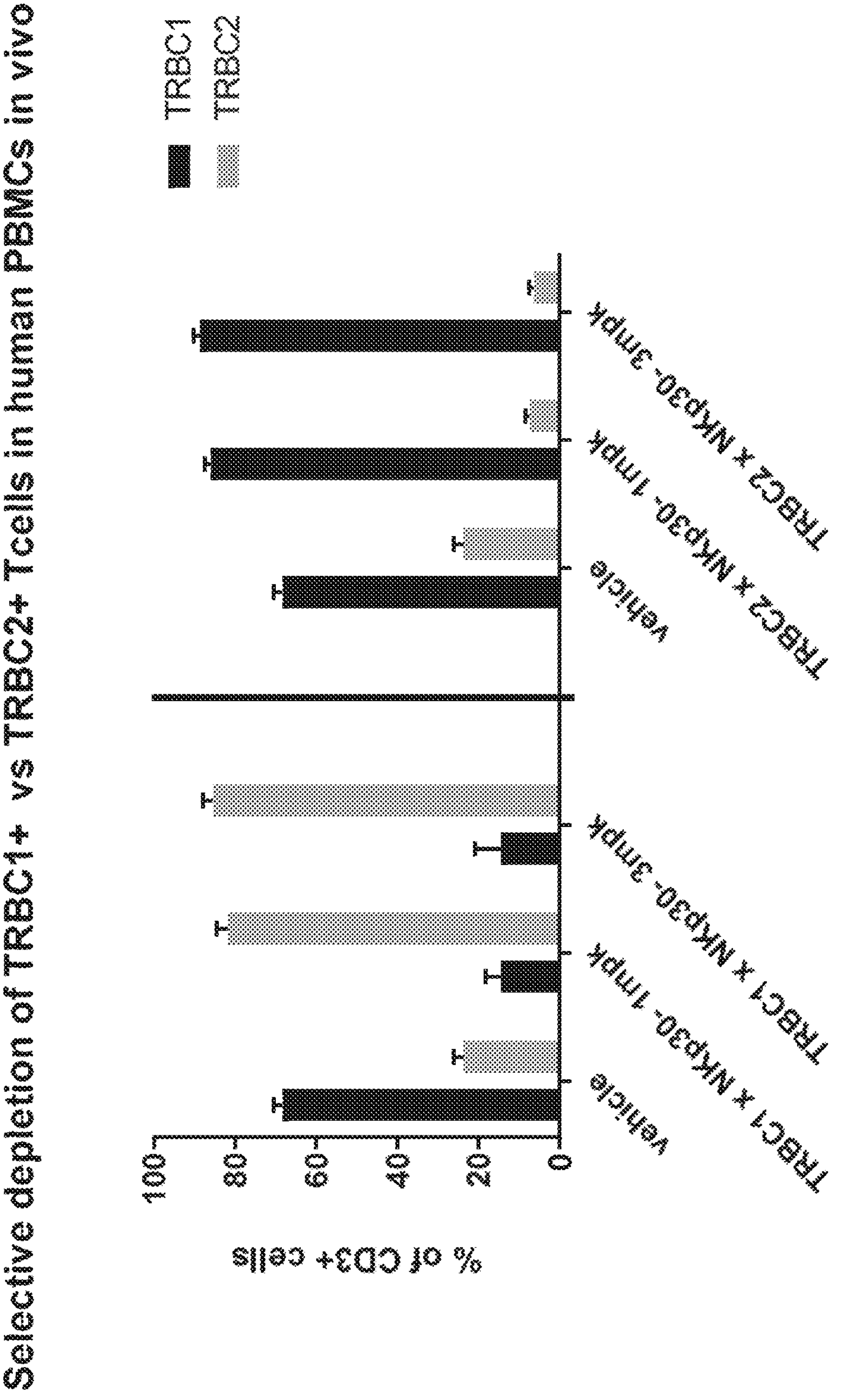
FIG. 38 is representative data showing specific depletion TRBC1+vs TRBC2+T cells from human PBMCs using either TRBC1xNKp30 or TRBC2xNKp30 bispecific antibodies in vivo. Mice were administered human PBMCs at day 0, and treated with either TRBC1x NKp30 or TRBC2x NKp30 antibodies, and whole blood was harvested on day 7.

Heparinized whole blood was transferred to cluster tubes, lysed with ACK lysis buffer followed by 20 min Fc Block. Blood from mice treated with TRBC2x NKp30 was stained with Jovi.1 (TRBC1 antibody) while blood from mice treated with TRBC1x NKp30 was stained with BKM0213 (TRBC2 antibody). Cells were washed in PBS followed by staining with antibody cocktail containing CD56− PE (NK Marker), CD3− AF700 (T-Cell Marker), CD4− BV421 (T-Cell Marker), CD8− Percp cy5.5 (T-Cell Marker), CD25− PE Dazzle (Late Activation), CD69− BV605 (Early Activation) and Live/Dead staining. The cells were then fixed, and flow assessments were acquired on CytoFLEX LX. FIG. 38 shows that the TRBC2x NKp30 specifically depletes TRBC2+ population of T cells in vivo while sparing the TRBC1+ population, while TRBC1x NKp30 specifically depletes TRBC1+ population of T cells in vivo while sparing the TRBC2+ population. Similar activity was noted in splenocytes (data not shown) and the findings are like those found in vitro. In addition, increased activation of CD56+ CD69+CD25+ NK cells (30%) were noted in mice treated with anti-NKp30xTRBC1 and anti-NKp30xTRBC2 (data not shown).

Example 29. Antitumor Activity of TRBC2x NKp30 Bispecific in TRBC2+ T-NHL Cell Line-Derived Mouse Model In-Vivo Humanized models of T-NHL have been utilized to evaluate the antitumor activity of TRBC2x NKp30 bispecific. 6-8 wk female NOG-IL-15 mice were implanted subcutaneously with HPB-ALL tumor cells. Once tumor burden was established, at day 12 post tumor implant, mice were intravenously engrafted with in vitro expanded primary NK cells. 5 days following NK implant (17 days post tumor implant), mice were randomized by tumor volume and dosed either with PBS control, anti-TRBC2xNKp30 (BKM0311) antibody, monovalent anti-TRBC2 antibody (BKM0343) anti-NKp30 (BJM1077) antibody at a dose of 1 mg/kg and twice a weekly schedule (total of 6 doses). Tumor volume and body weight was measured twice weekly during the study duration.

Figure 39:
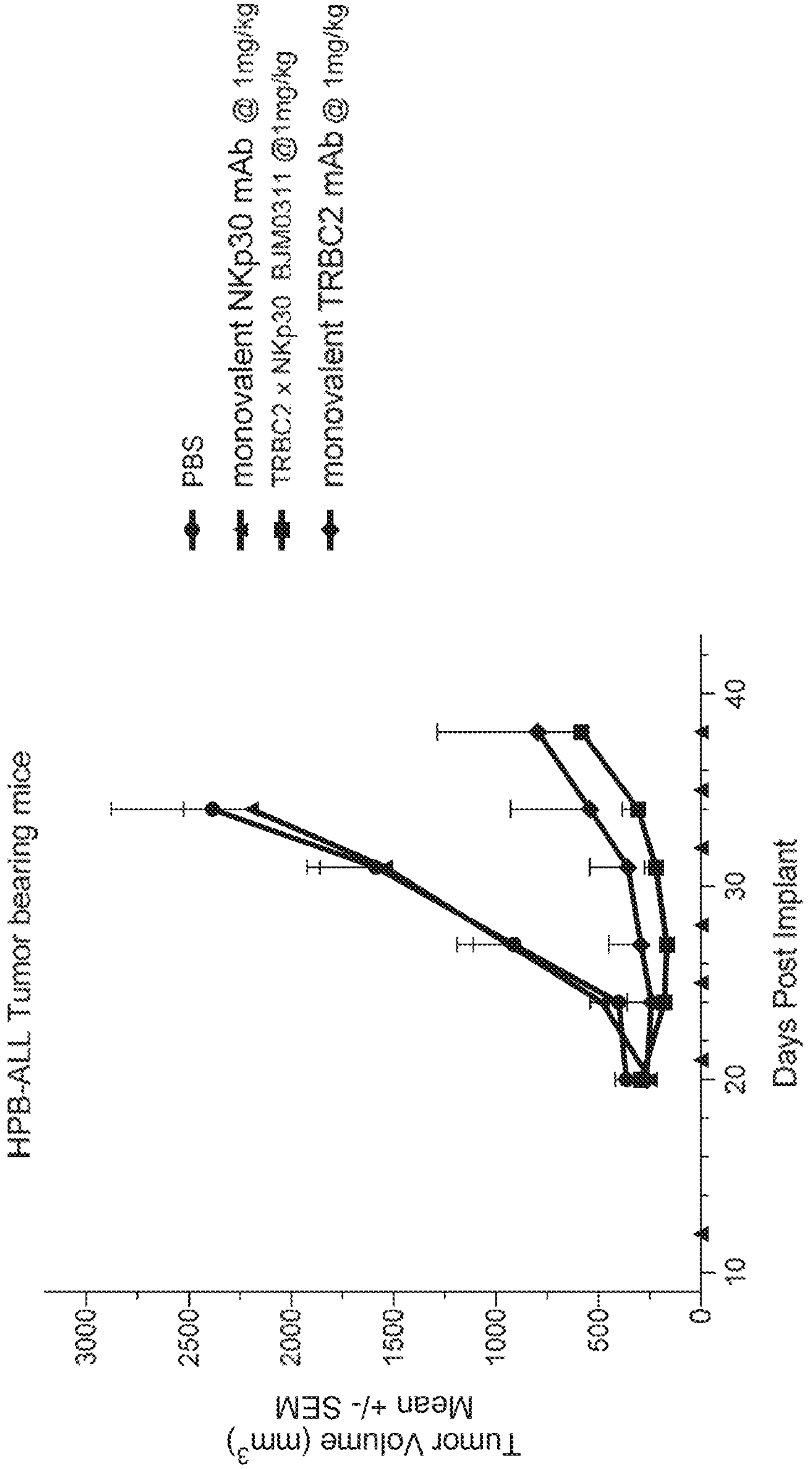
FIG. 39 is representative data showing significant antitumor activity in TRBC2+ HPB-ALL derived xenograft mouse model engrafted with human NK cells.

The TRBC2x NKp30 antibody BKM0311 antibody showed dose linear serum exposure (data not shown) and induced HPB-ALL subcutaneous tumor stasis and a TGI of 87% at a dose of 1 mg/kg in primary NK cell-engrafted NOG IL-15 mice (FIG. 39). Similar results were observed with the anti-TRBC2 control antibody, BJM0343, albeit to a slightly lesser extent; anti-NKp30 control treatment showed no antitumor effects.

Example 30. Knob-into-Hole (KIH) Designs of Bi-Specific Antibodies

Sequences of specific exemplary KIH designs for TRBC1xNKp30 bispecifics and TRBC2xNKp30 bispecifics are shown below in Table 39.

TABLE 39

Sequences of Knob-into-Hole designs of mono- and bi-specific antibodies (CDR sequences in the amino acid chains are underlined)

| | |
|---|---|
| 1. Anti-TRBC2-NKp30-BIS-9 BKM0313 (TRBC2/NKp30 bispecific) | |
| Knob chain (TRBC2 Fab-Fc) | Light Chain (LC)<br>DVVMTQSPLSLPVTLGQPASISCRSSKNLVHSNGRTYLQWYQQRPGQSPRLLI<br>YRVSNRFPGVPDRFSGSGSGTDFTLKISRVEAEDVGVYFCSQSTREPYTFGGGT<br>KVEIKRTVAAPSVFIFPPSDEQLKSGTASVVCLLNNFYPREAKVQWKVDNALQ<br>SGNSQESVTEQDSKDSTYSLSSTLTLSKADYEKHKVYACEVTHQGLSSPVTKS<br>FNRGEC (SEQ ID NO: 8281)<br>LC Variable region:<br>DVVMTQSPLSLPVTLGQPASISCCDRRSSKNLVHSNGRTYLQWYQQRPGQSPRLL<br>IYRVSNRFPGVPDRFSGSGSGTDFTLKISRVEAEDVGVYFCSQSTREPYTFGGGTK<br>VEIK (SEQ ID NO: 8282)<br>LC-CDR1 sequence:<br>RSSKNLVHSNGRTYLQ (SEQ ID NO: 8051)<br>LC-CDR2 sequence:<br>RVSNRFP (SEQ ID NO: 8049)<br>LC-CDR3 sequence:<br>SQSTREPYT (SEQ ID NO: 8052)<br>Heavy chain (HC):<br>QVQLVQSGAEVKKPGSSVKVSCKASPRGFYGYHMHWVRQAPGQGLEWMGFI<br>NPYNNHIQYNERFRGRVTITSDESTTTAYMELSSLRSEDTAVYYCALGIGKWGD<br>GAYRFFDFWGQGTLVTVSSASTKGPSVFPLAPSSKSTSGGTAALGCLVKDYFPE<br>PVTVSWNSGALTSGVHTFPAVLQSSGLYSLSSVVTVPSSSLGTQTYICNVNHKPS<br>NTKVDKRVEPKSCDKTHTCPPCPAPELLGGPSVFLFPPKPKDTLMISRTPEVTCV<br>VVDVSHEDPEVKFNWYVDGVEVHNAKTKPREEQYASTYRVVSVLTVLHQDWL<br>NGKEYKCKVSNKALPAPIEKTISKAKGQPREPQVYTLPPCREEMTKNQVSLWCL<br>VKGFYPSDIAVEWESNGQPENNYKTTPPVLDSDGSFFLYSKLTVDKSRWQQGN<br>VFSCSVMHEALHNHYTQKSLSLSPGK (SEQ ID NO: 8283) |

TABLE 39-continued

Sequences of Knob-into-Hole designs of mono- and bi-specific antibodies
(CDR sequences in the amino acid chains are underlined)

| | |
|---|---|
| | HC Variable region<br>QVQLVQSGAEVKKPGSSVKVSCKASPRGFYGYHMHWVRQAPGQGLEWMGFI<br>NPYNNHIQYNERFRGRVTITSDESTTTAYMELSSLRSEDTAVYYCALGIGKWGD<br>GAYRFFDFWGQGTLVTVSS (SEQ ID NO: 8284)<br>HC-CDR1<br>PRGFYGYHMH (SEQ ID NO: 8272)<br>HC-CDR2<br>FINPYNNHIQYNERFRG (SEQ ID NO: 8044)<br>HC-CDR3<br>GIGKWGDGAYRFFDE (SEQ ID NO: 8285) |
| Hole chain (NKp30 scFv-Fc) | Full chain sequence<br>EIQLLESGGGLVQPGGSLRLSCAVSGFSITTTGYHWNWVRQAPGKGLEWVGYIY<br>SSGSTSYNPSLKSRFTISRDTSKNTFYLQMNSLRAEDTAVYYCARGDWHYFDYW<br>GQGTMVTVSSGGGGSGGGGSGGGGSGGGGSDSVTTQSPLSLPVTLGQPASISCSG<br>EKLSDKYVHWYQQRPGQSPRMLIYENDRRPSGVPDRFSGSNSGNDATLKISRVEA<br>EDVGVYFCQFWDSTNSAVFGGGTKVEIKDKTHTCPPCPAPELLGGPSVFLFPPKP<br>KDTLMISRTPEVTCVVVDVSHEDPEVKFNWYVDGVEVHNAKTKPREEQYASTYR<br>VVSVLTVLHQDWLNGKEYKCKVSNKALPAPIEKTISKAKGQPREPQVCTLPPSRE<br>EMTKNQVSLSCAVKGFYPSDIAVEWESNGQPENNYKTTPPVLDSDGSFFLVSKLT<br>VDKSRWQQGNVFSCSVMHEALHNHYTQKSLSLSPGK (SEQ ID NO: 8286)<br>NKp30 scFv ScFv<br>EIQLLESGGGLVQPGGSLRLSCAVSGFSITTTGYHWNWVRQAPGKGLEWVGYIY<br>SSGSTSYNPSLKSRFTISRDTSKNTFYLQMNSLRAEDTAVYYCARGDWHYFDYW<br>GQGTMVTVSSGGGGSGGGGSGGGGSGGGGSDSVTTQSPLSLPVTLGQPASISCSG<br>EKLSDKYVHWYQQRPGQSPRMLIYENDRRPSGVPDRFSGSNSGNDATLKISRVEA<br>EDVGVYFCQFWDSTNSAVFGGGTKVEIK (SEQ ID NO: 8287)<br>Heavy chain sequence<br>EIQLLESGGGLVQPGGSLRLSCAVSGFSITTTGYHWNWVRQAPGKGLEWVGYIY<br>SSGSTSYNPSLKSRFTISRDTSKNTFYLQMNSLRAEDTAVYYCARGDWHYFDYW<br>GQGTMVTVSS (SEQ ID NO: 8030)<br>HC-CDR1: GFSITTTGYHWN (SEQ ID NO: 8288)<br>HC-CDR2: YIYSSGSTSYNPSLKS (SEQ ID NO: 8289)<br>HC-CDR3: GDWHYFDY (SEQ ID NO: 8290)<br>Light Chain sequence<br>DSVTTQSPLSLPVTLGQPASISCSGEKLSDKYVHWYQQRPGQSPRMLIYENDRRPS<br>GVPDRFSGSNSGNDATLKISRVEAEDVGVYFCQFWDSTNSAVFGGGTKVEIK<br>(SEQ ID NO: 7309)<br>LC-CDR1: SGEKLSDKYVH (SEQ ID NO: 7326)<br>LC-CDR2: ENDRRPS (SEQ ID NO: 7327) (SEQ ID NO: 8057),<br>(SEQ ID NO: 6006)<br>LC-CDR3: QFWDSTNSAV (SEQ ID NO: 7329), (SEQ ID NO: 8058), (SEQ ID NO: 7329)<br>Linker sequence<br>GGGGSGGGGSGGGGSGGGGS (SEQ ID NO: 8291) |
| | 2. Anti-TRBC2-NKp30-BIS-10 BKM0314 (TRBC2/NKp30 bispecific) |
| Knob chain (TRBC2 Fab-Fc) | Light Chain (LC)<br>DVVMTQSPLSLPVTLGQPASISCRSSKNLVHSNGRTYLQWYQQRPGQSPRLLIYR<br>VSNRFPGVPDRFSGSGSGTDFTLKISRVEAEDVGVYFCSQSTREPYTFGGGTKVEI<br>KRTVAAPSVFIFPPSDEQLKSGTASVVCLLNNFYPREAKVQWKVDNALQSGNSQE<br>SVTEQDSKDSTYSLSSTLTLSKADYEKHKVYACEVTHQGLSSPVTKSFNRGEC<br>(SEQ ID NO: 8292)<br>LC Variable region<br>DVVMTQSPLSLPVTLGQPASISCRSSKNLVHSNGRTYLQWYQQRPGQSPRLLIYR<br>VSNRFPGVPDRFSGSGSGTDFTLKISRVEAEDVGVYFCSQSTREPYTFGGGTKVEI<br>K (SEQ ID NO: 8293)<br>LC-CDR1<br>RSSKNLVHSNGRTYLQ (SEQ ID NO: 8051)<br>LC-CDR2<br>RVSNRFP (SEQ ID NO: 224), (SEQ ID NO: 8049)<br>LC-CDR3<br>SQSTREPYT (SEQ ID NO: 8052)<br>Heavy chain (HC):<br>QVQLVQSGAEVKKPGSSVKVSCKASPRGFYGYHMHWVRQAPGQGLEWMGFINP<br>YNNHIQYNERFRGRVTITSDESTTTAYMELSSLRSEDTAVYYCALGVGKWGDGA<br>YRFFDFWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPSNTK<br>VDKRVEPKSCDKTHTCPPCPAPELLGGPSVFLFPPKPKDTLMISRTPEVTCVVVDV<br>SHEDPEVKFNWYVDGVEVHNAKTKPREEQYASTYRVVSVLTVLHQDWLNGKEY<br>KCKVSNKALPAPIEKTISKAKGQPREPQVYTLPPCREEMTKNQVSLWCLVKGFYP<br>SDIAVEWESNGQPENNYKTTPPVLDSDGSFFLYSKLTVDKSRWQQGNVFSCSVM<br>HEALHNHYTQKSLSLSPGK (SEQ ID NO: 8294)<br>HC-Variable region<br>QVQLVQSGAEVKKPGSSVKVSCKASPRGFYGYHMHWVRQAPGQGLEWMGFINP<br>YNNHIQYNERFRGRVTITSDESTTTAYMELSSLRSEDTAVYYCALGVGKWGDGA<br>YRFFDFWGQGTLVTVSS (SEQ ID NO: 8295) |

TABLE 39-continued

| Sequences of Knob-into-Hole designs of mono- and bi-specific antibodies (CDR sequences in the amino acid chains are underlined) | |
|---|---|
| | HC-CDR1<br>PRGFYGYHMH (SEQ ID NO: 8219)<br>HC-CDR2<br>FINPYNNHIQYNERFRG (SEQ ID NO: 8044)<br>HC-CDR3<br>GVGKWGDGAYRFFDF (SEQ ID NO: 8296) |
| Hole chain (Nkp30 scFv-Fc) | EIQLLESGGGLVQPGGSLRLSCAVSGFSITTTGYHWNWVRQAPGKGLEWVGYIYS<br>SGSTSYNPSLKSRFTISRDTSKNTFYLQMNSLRAEDTAVYYCARGDWHYFDYWGQ<br>GTMVTVSSGGGGSGGGGSGGGGSGGGGSDSVTTQSPLSLPVTLGQPASISCSGEK<br>LSDKYVHWYQQRPGQSPRMLIYENDRRPSGVPDRFSGSNSGNDATLKISRVEAED<br>VGVYFCQFWDSTNSAVFGGGTKVEIKDKTHTCPPCPAPELLGGPSVFLFPPKPKD<br>TLMISRTPEVTCVVVDVSHEDPEVKFNWYVDGVEVHNAKTKPREEQYASTYRVV<br>SVLTVLHQDWLNGKEYKCKVSNKALPAPIEKTISKAKGQPREPQVCTLPPSREEM<br>TKNQVSLSCAVKGFYPSDIAVEWESNGQPENNYKTTPPVLDSDGSFFLVSKLTVD<br>KSRWQQGNVFSCSVMHEALHNHYTQKSLSLSPGK (SEQ ID NO: 8286)<br>NKp30 ScFv<br>EIQLLESGGGLVQPGGSLRLSCAVSGFSITTTGYHWNWVRQAPGKGLEWVGYIYS<br>SGSTSYNPSLKSRFTISRDTSKNTFYLQMNSLRAEDTAVYYCARGDWHYFDYWG<br>QGTMVTVSSGGGGSGGGGSGGGGSGGGGSDSVTTQSPLSLPVTLGQPASISCSGE<br>KLSDKYVHWYQQRPGQSPRMLIYENDRRPSGVPDRFSGSNSGNDATLKISRVEAE<br>DVGVYFCQFWDSTNSAVFGGGTKVEIK (SEQ ID NO: 8287)<br>Heavy chain sequence<br>EIQLLESGGGLVQPGGSLRLSCAVSGFSITTTGYHWNWVRQAPGKGLEWVGYIYS<br>SGSTSYNPSLKSRFTISRDTSKNTFYLQMNSLRAEDTAVYYCARGDWHYFDYWG<br>QGTMVTVSS (SEQ ID NO: 8030)<br>Light chain sequence<br>DSVTTQSPLSLPVTLGQPASISCSGEKLSDKYVHWYQQRPGQSPRMLIYENDRRPS<br>GVPDRFSGSNSGNDATLKISRVEAEDVGVYFCQFWDSTNSAVFGGGTKVEIK<br>(SEQ ID NO: 7309)<br>Linker sequence<br>GGGGSGGGGSGGGGSGGGGS (SEQ ID NO: 8291) |
| 3. Anti-TRBC2-M11 BKM0343 (TRBC2 monovalent mAb) | |
| Knob chain (TRBC2 Fab-Fc) | Light chain sequence<br>DVVMTQSPLSLPVTLGQPASISCRSSKNLVHSNGRTYLQWYQQRPGQSPRLLIYR<br>VSNRFPGVPDRFSGSGSGTDFTLKISRVEAEDVGVYFCSQSTREPYTFGGGTKVEI<br>KRTVAAPSVFIFPPSDEQLKSGTASVVCLLNNFYPREAKVQWKVDNALQSGNSQE<br>SVTEQDSKDSTYSLSSTLTLSKADYEKHKVYACEVTHQGLSSPVTKSFNRGEC<br>(SEQ ID NO: 8297)<br>Variable region<br>DVVMTQSPLSLPVTLGQPASISCRSSKNLVHSNGRTYLQWYQQRPGQSPRLLIYR<br>VSNRFPGVPDRFSGSGSGTDFTLKISRVEAEDVGVYFCSQSTREPYTFGGGTKVEI<br>K (SEQ ID NO: 8021)<br>LC-CDR1<br>RSSKNLVHSNGRTYLQ (SEQ ID NO: 8051)<br>LC-CDR2<br>RVSNRFP (SEQ ID NO: 224), (SEQ ID NO: 8049)<br>LC-CDR3<br>SQSTREPYT (SEQ ID NO: 8052)<br>Heavy chain sequence<br>QVQLVQSGAEVKKPGSSVKVSCKASPRGFYGYHMHWVRQAPGQGLEWMGFINP<br>YNNHIQYNERFRGRVTITSDESTTTAYMELSSLRSEDTAVYYCALGEGKWGDGA<br>YRFFDFWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPSNTK<br>VDKRVEPKSCDKTHTCPPCPAPELLGGPSVFLFPPKPKDTLMISRTPEVTCVVVDV<br>SHEDPEVKFNWYVDGVEVHNAKTKPREEQYASTYRVVSVLTVLHQDWLNGKEY<br>KCKVSNKALPAPIEKTISKAKGQPREPQVYTLPPCREEMTKNQVSLWCLVKGFYP<br>SDIA VEWESNGQPENNYKTTPPVLDSDGSFFLYSKLTVDKSRWQQGNVFSCSVM<br>HEALHNHYTQKSLSLSPGK (SEQ ID NO: 8298)<br>Variable region<br>QVQLVQSGAEVKKPGSSVKVSCKASPRGFYGYHMHWVRQAPGQGLEWMGFINP<br>YNNHIQYNERFRGRVTITSDESTTTAYMELSSLRSEDTAVYYCALGEGKWGDGA<br>YRFFDFWGQGTLVTVSS (SEQ ID NO: 8299)<br>HC-CDR1<br>PRGFYGYHMH (SEQ ID NO: 8219). (SEQ ID NO: 8272)<br>HC-CDR2<br>FINPYNNHIQYNERFRG (SEQ ID NO: 8044)<br>HC-CDR3<br>GEGKWGDGAYRFFDF (SEQ ID NO: 8046) |
| Hole chain (Fc) | DKTHTCPPCPAPELLGGPSVFLFPPKPKDTLMISRTPEVTCVVVDVSHEDPEVKFN<br>WYVDGVEVHNAKTKPREEQYASTYRVVSVLTVLHQDWLNGKEYKCKVSNKAL<br>PAPIEKTISKAKGQPREPQVCTLPPSREEMTKNQVSLSCAVKGFYPSDIAVEWESN<br>GQPENNYKTTPPVLDSDGSFFLVSKLTVDKSRWQQGNVFSCSVMHEALHNHYTQ<br>KSLSLSPGK (SEQ ID NO: 8300) |

TABLE 39-continued

| Sequences of Knob-into-Hole designs of mono- and bi-specific antibodies (CDR sequences in the amino acid chains are underlined) | |
|---|---|
| 4. Anti-TRBC2-M12 BKM0344 (TRBC2 monovalent mAb) | |
| Knob chain (TRBC2 Fab-Fc) | Light Chain<br>DVVMTQSPLSLPVTLGQPASISCRSSKNLVHSNGRTYLQWYQQRPGQSPRLLIYR VSNRFPGVPDRFSGSGSGTDFTLKISRVEAEDVGVYFCSQSTREPYTFGGGTKVEI KRTVAAPSVFIFPPSDEQLKSGTASVVCLLNNFYPREAKVQWKVDNALQSGNSQ ESVTEQDSKDSTYSLSSTLTLSKADYEKHKVYACEVTHQGLSSPVTKSFNRGEC (SEQ ID NO: 8301)<br>Light chain variable region<br>DVVMTQSPLSLPVTLGQPASISCRSSKNLVHSNGRTYLQWYQQRPGQSPRLLIYR VSNRFPGVPDRFSGSGSGTDFTLKISRVEAEDVGVYFCSQSTREPYTFGGGTKVEI K (SEQ ID NO: 8021)<br>LC-CDR1<br>RSSKNLVHSNGRTYLQ (SEQ ID NO: 8051)<br>LC-CDR2<br>RVSNRFP (SEQ ID NO: 224), (SEQ ID NO: 8049)<br>LC-CDR3<br>SQSTREPYT (SEQ ID NO: 8052)<br>Heavy Chain<br>QVQLVQSGAEVKKPGSSVKVSCKASPRGFYGYHMHWVRQAPGQGLEWMGFIN PYNNHIQYNERFRGRVTITSDESTTTAYMELSSLRSEDTAVYYCALGAGKWGDG AYRFFDFWGQGTLVTVSSASTKGPSVFPLAPSSKSTSGGTAALGCLVKDYFPEPV TVSWNSGALTSGVHTFPAVLQSSGLYSLSSVVTVPSSSLGTQTYICNVNHKPSNT KVDKRVEPKSCDKTHTCPPCPAPELLGGPSVFLFPPKPKDTLMISRTPEVTCVVV DVSHEDPEVKFNWYVDGVEVHNAKTKPREEQYASTYRVVSVLTVLHQDWLNG KEYKCKVSNKALPAPIEKTISKAKGQPREPQVYTLPPCREEMTKNQVSLWCLVK GFYPSDIAVEWESNGQPENNYKTTPPVLDSDGSFFLYSKLTVDKSRWQQGNVFS CSVMHEALHNHYTQKSLSLSPGK (SEQ ID NO: 8302)<br>Variable region<br>QVQLVQSGAEVKKPGSSVKVSCKASPRGFYGYHMHWVRQAPGQGLEWMGFIN PYNNHIQYNERFRGRVTITSDESTTTAYMELSSLRSEDTAVYYCALGAGKWGDG AYRFFDFWGQGTLVTVSS (SEQ ID NO: 8303)<br>HC-CDR1<br>PRGFYGYHMH (SEQ ID NO: 8272)<br>HC-CDR2<br>FINPYNNHIQYNERFRG (SEQ ID NO: 8044)<br>HC-CDR3<br>GAGKWGDGAYRFFDF (SEQ ID NO: 8047) |
| Hole chain (Fc) | DKTHTCPPCPAPELLGGPSVFLFPPKPKDTLMISRTPEVTCVVVDVSHEDPEVKF NWYVDGVEVHNAKTKPREEQYASTYRVVSVLTVLHQDWLNGKEYKCKVSNK ALPAPIEKTISKAKGQPREPQVCTLPPSREEMTKNQVSLSCAVKGFYPSDIAVEW ESNGQPENNYKTTPPVLDSDGSFFLVSKLTVDKSRWQQGNVFSCSVMHEALHN HYTQKSLSLSPGK (SEQ ID NO: 8300) |
| 5. Anti-TRBC1-NKp30-BIS-13 BJM1042 (TRBC1/NKp30 bispecific) | |
| Knob chain (TRBC1 Fab-Fc) | Light Chain<br>DVVMTQSPLSLPVTLGQPASISCRSSQRLVHSNGNTYLHWYQQRPGQSPRLLIY RVSNRFPGVPDRFSGSGSGTDFTLKISRVEAEDVGVYFCSQSTHVPYTFGGGTK VEIKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSFNR GEC (SEQ ID NO: 7380)<br>Light chain variable region<br>DVVMTQSPLSLPVTLGQPASISCRSSQRLVHSNGNTYLHWYQQRPGQSPRLLIY RVSNRFPGVPDRFSGSGSGTDFTLKISRVEAEDVGVYFCSQSTHVPYTFGGGTK VEIK (SEQ ID NO: 258)<br>LC-CDR1<br>RSSQRLVHSNGNTYLH (SEQ ID NO: 223)<br>LC-CDR2<br>RVSNRFP (SEQ ID NO: 224), (SEQ ID NO: 8049)<br>LC-CDR3<br>SQSTHVPYT (SEQ ID NO: 8210)<br>Heavy chain<br>QVQLVQSGAEVKKPGSSVKVSCKASGYTFTGYVMHWVRQAPGQGLEWMGFII PIFGTANYAQKFQGRVTITSDKSTTTAYMELSSLRSEDTAVYYCARGAGYNFDG AYRFFDFWGQGTLVTVSSASTKGPSVFPLAPSSKSTSGGTAALGCLVKDYFPEPV TVSWNSGALTSGVHTFPAVLQSSGLYSLSSVVTVPSSSLGTQTYICNVNHKPSNT KVDKRVEPKSCDKTHTCPPCPAPELLGGPSVFLFPPKPKDTLMISRTPEVTCVVV DVSHEDPEVKFNWYVDGVEVHNAKTKPREEQYASTYRVVSVLTVLHQDWLN GKEYKCKVSNKALPAPIEKTISKAKGQPREPQVYTLPPCREEMTKNQVSLWCLVK GFYPSDIAVEWESNGQPENNYKTTPPVLDSDGSFFLYSKLTVDKSRWQQGNVFSC S<br>VMHEALHNHYTQKSLSLSPGK (SEQ ID NO: 7382)<br>HC-variable region<br>QVQLVQSGAEVKKPGSSVKVSCKASGYTFTGYVMHWVRQAPGQGLEWMGFII PIFGTANYAQKFQGRVTITSDKSTTTAYMELSSLRSEDTAVYYCARGAGYNFDG AYRFFDFWGQGTLVTVSS (SEQ ID NO: 8304) |

TABLE 39-continued

| Sequences of Knob-into-Hole designs of mono- and bi-specific antibodies (CDR sequences in the amino acid chains are underlined) | |
|---|---|
| | HC-CDR1<br>GYTFTGYVMH (SEQ ID NO: 8305)<br>HC-CDR2<br>FIIPIFGTANYAQKFOG (SEQ ID NO: 7355),<br>HC-CDR3<br>GAGYNFDGAYRFFDF (SEQ ID NO: 202) |
| Hole chain (NKp30 scFv-Fc) | EIQLLESGGGLVQPGGSLRLSCAVSGFSITTTGYHWNWVRQAPGKGLEWVGYIYS<br>SGSTSYNPSLKSRFTISRDTSKNTFYLQMNSLRAEDTAVYYCARGDWHYFDYWG<br>QGTMVTVSSGGGGSGGGGSGGGGSGGGGSDSVTTQSPLSLPVTLGQPASISCSGE<br>KLSDKYVHWYQQRPGQSPRMLIYENDRRPSGVPDRFSGSNSGNDATLKISRVEAE<br>DVGVYFCQFWDSTNSAVFGGGTKVEIKDKTHTCPPCPAPELLGGPSVFLFPPKPK<br>DTLMISRTPEVTCVVVDVSHEDPEVKFNWYVDGVEVHNAKTKPREEQYASTYRV<br>VSVLTVLHQDWLNGKEYKCKVSNKALPAPIEKTISKAKGQPREPQVCTLPPSREE<br>MTKNQVSLSCAVKGFYPSDIAVEWESNGQPENNYKTTPPVLDSDGSFFLVSKLTV<br>DKSRWQQGNVFSCSVMHEALHNHYTQKSLSLSPGK (SEQ ID NO: 8286)<br>Variable region<br>EIQLLESGGGLVQPGGSLRLSCAVSGFSITTTGYHWNWVRQAPGKGLEWVGYIYS<br>SGSTSYNPSLKSRFTISRDTSKNTFYLQMNSLRAEDTAVYYCARGDWHYFDYWG<br>QGTMVTVSSGGGGSGGGGSGGGGSGGGGSDSVTTQSPLSLPVTLGQPASISCSGE<br>KLSDKYVHWYQQRPGQSPRMLIYENDRRPSGVPDRFSGSNSGNDATLKISRVEAE<br>DVGVYFCQFWDSTNSAVFGGGTKVEIK (SEQ ID NO: 8287)<br>Heavy chain sequence<br>EIQLLESGGGLVQPGGSLRLSCAVSGESITTTGYHWNWVRQAPGKGLEWVGYIYS<br>SGSTSYNPSLKSRFTISRDTSKNTFYLQMNSLRAEDTAVYYCARGDWHYFDYWG<br>QG<br>TMVTVSS (SEQ ID NO: 8030)<br>Light chain sequence<br>DSVTTQSPLSLPVTLGQPASISCSGEKLSDKYVHWYQQRPGQSPRMLIYENDRRPS<br>GVPDRFSGSNSGNDATLKISRVEAEDVGVYFCQFWDSTNSAVFGGGTKVEIK<br>(SEQ ID NO: 7309)<br>Linker<br>GGGGSGGGGSGGGGSGGGGS (SEQ ID NO: 8291) |
| 6. Anti-NKp30-M-14 BJM1077 (monovalent NKp30 scFv-Fc) (monovalent control NKp30 binder only) | |
| Knob chain (Fc) | DKTHTCPPCPAPELLGGPSVFLFPPKPKDTLMISRTPEVTCVVVDVSHEDPEVKFN<br>WYVDGVEVHNAKTKPREEQYASTYRVVSVLTVLHQDWLNGKEYKCKVSNKAL<br>PAPIEKTISKAKGQPREPQVYTLPPCREEMTKNQVSLWCLVKGFYPSDIAVEWES<br>NGQPENNYKTTPPVLDSDGSFFLYSKLTVDKSRWQQGNVFSCSVMHEALHNHYT<br>QKSLSLSPGK (SEQ ID NO: 8306) |
| Hole Chain (NKp30 scFv-Fc) | EIQLLESGGGLVQPGGSLRLSCAVSGFSITTTGYHWNWVRQAPGKGLEWVGYIYS<br>SGSTSYNPSLKSRFTISRDTSKNTFYLQMNSLRAEDTAVYYCARGDWHYFDYWG<br>QGTMVTVSSGGGGGGGGSGGGGSGGGGSDSVTTQSPLSLPVTLGQPASISCSGE<br>KLSDKYVHWYQQRPGQSPRMLIYENDRRPSGVPDRFSGSNSGNDATLKISRVEAE<br>DVGVYFCQFWDSTNSAVFGGGTKVEIKDKTHTCPPCPAPELLGGPSVFLFPPKPK<br>DTLMISRTPEVTCVVVDVSHEDPEVKFNWYVDGVEVHNAKTKPREEQYASTYRV<br>VSVLTVLHQDWLNGKEYKCKVSNKALPAPIEKTISKAKGQPREPQVCTLPPSREE<br>MTKNQVSLSCAVKGFYPSDIAVEWESNGQPENNYKTTPPVLDSDGSFFLVSKLTV<br>DKSRWQQGNVFSCSVMHEALHNHYTQKSLSLSPGK (SEQ ID NO: 8286)<br>NKp30 ScFv<br>EIQLLESGGGLVQPGGSLRLSCAVSGFSITTTGYHWNWVRQAPGKGLEWVGYIYS<br>SGSTSYNPSLKSRFTISRDTSKNTFYLQMNSLRAEDTAVYYCARGDWHYFDYWG<br>QGTMVTVSSGGGGSGGGGSGGGGSGGGGSDSVTTQSPLSLPVTLGQPASISCSGE<br>KLSDKYVHWYQQRPGQSPRMLIYENDRRPSGVPDRFSGSNSGNDATLKISRVEAE<br>DVGVYFCQFWDSTNSAVFGGGTKVEIK (SEQ ID NO: 8287)<br>Heavy chain sequence<br>EIQLLESGGGLVQPGGSLRLSCAVSGFSITTTGYHWNWVRQAPGKGLEWVGYIYS<br>SGSTSYNPSLKSRFTISRDTSKNTFYLQMNSLRAEDTAVYYCARGDWHYFDYWG<br>QGTMVTVSS (SEQ ID NO: 8030)<br>Light chain sequence<br>DSVTTQSPLSLPVTLGQPASISCSGEKLSDKYVHWYQQRPGQSPRMLIYENDRRPS<br>GVPDRFSGSNSGNDATLKISRVEAEDVGVYFCQFWDSTNSAVFGGGTKVEIK<br>(SEQ ID NO: 7309)<br>GGGGSGGGGSGGGGSGGGGS (SEQ ID NO: 8291) |
| 7. Anti-TRBC1-M15 BJM1083 (TRBC1 monovalent mAb) | |
| Knob chain (TRBC1 Fab-Fc) | Light Chain (LC)<br>DVVMTQSPLSLPVTLGQPASISCRSSQRLVHSNGNTYLHWYQQRPGQSPRLLIYR<br>VSNRFPGVPDRFSGSGSGTDFTLKISRVEAEDVGVYFCSQSTHVPYTFGGGTKVEI<br>KRTVAAPSVFIFPPSDEQLKSGTASVVCLLNNFYPREAKVQWKVDNALQSGNSQE<br>SVTEQDSKDSTYSLSSTLTLSKADYEKHKVYACEVTHQGLSSPVTKSFNRGEC<br>(SEQ ID NO: 8307) |

TABLE 39-continued

| Sequences of Knob-into-Hole designs of mono- and bi-specific antibodies (CDR sequences in the amino acid chains are underlined) | |
|---|---|
| | LC-Variable region<br>DVVMTQSPLSLPVTLGQPASISCRSSQRLVHSNGNTYLHWYQQRPGQSPRLLIYR<br>VSNRFPGVPDRFSGSGSGTDFTLKISRVEAEDVGVYFCSQSTHVPYTFGGGTKVEI<br>K (SEQ ID NO: 8308)<br>LC-CDR1<br>RSSQRLVHSNGNTYLH (SEQ ID NO: 223)<br>LC-CDR2<br>RVSNRFP (SEQ ID NO: 224), (SEQ ID NO: 8049)<br>LC-CDR3<br>SQSTHVPYT (SEQ ID NO: 225)<br>Heavy Chain (HC)<br>QVQLVQSGAEVKKPGSSVKVSCKASGYTFTGYVMHWVRQAPGQGLEWMGFII<br>PIFGTANYAQKFQGRVTITSDKSTTTAYMELSSLRSEDTAVYYCARGAGYNEDG<br>AYRFFDFWGQGTLVTVSSASTKGPSVFPLAPSSKSTSGGTAALGCLVKDYFPEPV<br>TVSWNSGALTSGVHTFPAVLQSSGLYSLSSVVTVPSSSLGTQTYICNVNHKPSNT<br>KVDKRVEPKSCDKTHTCPPCPAPELLGGPSVFLFPPKPKDTLMISRTPEVTCVVV<br>DVSHEDPEVKFNWYVDGVEVHNAKTKPREEQYASTYRVVSVLTVLHQDWLNG<br>KEYKCKVSNKALPAPIEKTISKAKGQPREPQVYTLPPCREEMTKNQVSLWCLVK<br>GFYPSDIAVEWESNGQPENNYKTTPPVLDSDGSFFLYSKLTVDKSRWQQGNVFS<br>CSVMHEALHNHYTQKSLSLSPGK (SEQ ID NO: 8309)<br>Variable region<br>QVQLVQSGAEVKKPGSSVKVSCKASGYTFTGYVMHWVRQAPGQGLEWMGFII<br>PIFGTANYAQKFQGRVTITSDKSTTTAYMELSSLRSEDTAVYYCARGAGYNFDG<br>AYRFFDFWGQGTLVTVSS (SEQ ID NO: 8310)<br>HC-CDR1<br>GYTFTGYVMH (SEQ ID NO: 8305)<br>HC-CDR2<br>FIIPIFGTANYAQKFQG (SEQ ID NO: 7355)<br>HC-CDR3<br>GAGYNFDGAYRFFDE (SEQ ID NO: 202) |
| Hole chain (Fc) | DKTHTCPPCPAPELLGGPSVFLFPPKPKDTLMISRTPEVTCVVVDVSHEDPEVK<br>FNWYVDGVEVHNAKTKPREEQYASTYRVVSVLTVLHQDWLNGKEYKCKVSN<br>KALPAPIEKTISKAKGQPREPQVCTLPPSREEMTKNQVSLSCAVKGFYPSDIAVE<br>WESNGQPENNYKTTPPVLDSDGSFFLVSKLTVDKSRWQQGNVFSCSVMHEALH<br>NHYTQKSLSLSPGK (SEQ ID NO: 8300) |

ENUMERATED EMBODIMENTS

1. A multifunctional molecule, comprising:

(i) a first antigen binding domain that preferentially binds to a tumor antigen on a lymphoma cell (e.g., T cell), wherein the tumor antigen is T cell receptor beta chain constant domain 1 (TRBC1) or T cell receptor beta chain constant domain 2 (TRBC2), and (ii) one, two, or all of:

(a) an immune cell engager chosen from an NK cell engager (e.g., a molecule that binds to NKp30, NKp46, NKG2D, or CD 16), a T cell engager, a B cell engager, a dendritic cell engager, or a macrophage cell engager;

(b) a cytokine molecule or cytokine inhibitor molecule;

(c) a death receptor signal engager; and (d) a stromal modifying moiety.

1A. A multifunctional molecule, comprising:

(i) a first antigen binding domain that selectively binds to T cell receptor beta chain constant domain 1 (TRBC1) or T cell receptor beta chain constant domain 2 (TRBC2), and (ii) one, two, or all of:

(a) an immune cell engager chosen from an NK cell engager (e.g., a molecule that binds to NKp30, NKp46, NKG2D, or CD16), a T cell engager that binds to a T cell antigen other than CD3, a B cell engager, a dendritic cell engager, or a macrophage cell engager;

(b) a cytokine molecule or cytokine inhibitor molecule;

(c) a death receptor signal engager; and (d) a stromal modifying moiety.

2. A multifunctional molecule, comprising:

(i) a first antigen binding domain that selectively targets lymphocytes expressing T cell receptor beta chain constant domain 1 (TRBC1) or T cell receptor beta chain constant domain 2 (TRBC2), and (ii) one, two, or all of:

(a) an immune cell engager chosen from an NK cell engager (e.g., a molecule that binds to NKp30, NKp46, NKG2D, or CD16), a T cell engager, a B cell engager, a dendritic cell engager, or a macrophage cell engager;

(b) a cytokine molecule or cytokine inhibitor molecule;

(c) a death receptor signal engager; and (d) a stromal modifying moiety.

3. The multifunctional molecule of embodiment 1 or 2, wherein the multifunctional molecule:

(i) binds specifically to an epitope of TRBC1 or TRBC2, e.g., the same or similar epitope as the epitope recognized by an anti-TRBC1 or anti-TRBC2 antibody molecule as described herein;

(ii) shows the same or similar binding affinity or specificity, or both, as an anti-TRBC1 or anti-TRBC2 antibody molecule as described herein;

(iii) inhibits, e.g., competitively inhibits, the binding of an anti-TRBC1 or anti-TRBC2 antibody molecule as described herein;

(iv) binds the same or an overlapping epitope with an anti-TRBC1 or anti-TRBC2 antibody molecule as described herein; or (v) competes for binding, and/or binds the same epitope, with an anti-TRBC1 or anti-TRBC2 antibody molecule as described herein.

4. The multifunctional molecule of embodiment 3, wherein the anti-TRBC1 or anti-TRBC2 antibody molecule comprises one or more CDRs, framework regions, variable domains, heavy or light chains, or an antigen binding domain chosen from Table 1, Table 2A or Table 2B, Table 4, Table 7, Table 8, or a sequence substantially identical thereto.

5. The multifunctional molecule of any of embodiments 1-4, wherein the antigen or tumor antigen is TRBC1.

6. The multifunctional molecule of any of embodiments 1-4, wherein the antigen or tumor antigen is TRBC2.

7. The multifunctional molecule of any of embodiments 1-4 or 6, wherein the first antigen binding domain comprises an anti-TRBC2 antigen binding domain disclosed herein, e.g., comprises one or more CDRs, framework regions, variable regions, or antigen binding domains disclosed in any of Table 9A or Table 9B, Table 10, Table 11, Table 12, Table 13, Table 14, Table 15, Table 17, Table 39, or a sequence having at least 85%, 90%, 95%, or 99% identity thereto.

8. The multifunctional molecule of any one of embodiments 1-4, 6, or 7, wherein the first antigen binding domain has a higher affinity for a T cell receptor comprising TRBC2 than for a T cell receptor not comprising TRBC2, optionally wherein the $K_D$ for the binding between the first antigen binding domain and TRBC2 is no more than 40%, 30%, 20%, 10%, 1%, 0.1%, or 0.01% of the $K_D$ for the binding between the first antigen binding domain and a T cell receptor not comprising TRBC2.

9. The multifunctional molecule of any one of embodiments 1-4 or 6-8, wherein the first antigen binding domain has a higher affinity for a T cell receptor comprising TRBC2 than for a T cell receptor comprising TRBC1, optionally wherein the $K_D$ for the binding between the first antigen binding domain and TRBC2 is no more than 40%, 30%, 20%, 10%, 1%, 0.1%, or 0.01% of the $K_D$ for the binding between the first antigen binding domain and a T cell receptor comprising TRBC1.

10. The multifunctional molecule of any preceding embodiment, wherein binding of the first antigen binding domain to TRBC1 or TRBC2 on a lymphoma cell or lymphocyte (e.g., T cell) or the tumor antigen on the lymphoma cell (e.g., T cell) does not activate the lymphoma cell or lymphocyte, e.g., T cell.

11. The multifunctional molecule of any preceding embodiment, wherein binding of the first antigen binding domain to TRBC1 or TRBC2 on a lymphoma cell or lymphocyte (e.g., T cell) or the tumor antigen on the lymphoma cell e.g., T cell) does not appreciably activate the lymphoma cell or lymphocyte, e.g., T cell, (e.g., as measured by T cell proliferation, expression of a T cell activation marker (e.g., CD69 or CD25), and/or expression of a cytokine (e.g., TNFα and IFNγ).

12. The multifunctional molecule of any one of embodiments 1 or 2-11, wherein the multifunctional molecule preferentially binds to a lymphoma cell over a non-lymphoma cell, optionally wherein the binding between the multifunctional molecule and the lymphoma cell is more than 10, 20, 30, 40, or 50-fold greater than the binding between the multifunctional molecule and a non-lymphoma cell.

13. The multifunctional molecule of any one of embodiments 2-9, wherein:

(i) the binding between the multifunctional molecule and the lymphocyte expressing TRBC1 is more than 10, 20, 30, 40, or 50-fold greater than the binding between the multifunctional molecule and a lymphocyte that does not express TRBC1, or (ii) the binding between the multifunctional molecule and the lymphocyte expressing TRBC2 is more than 10, 20, 30, 40, or 50-fold greater than the binding between the multifunctional molecule and a lymphocyte that does not express TRBC2.

14. The multifunctional molecule of any one of embodiments 1-13, wherein the multifunctional molecule comprises an immune cell engager chosen from an NK cell engager, a T cell engager, a B cell engager, a dendritic cell engager, or a macrophage cell engager.

15. The multifunctional molecule of embodiment 14, wherein the immune cell engager binds to and activates an immune cell, e.g., an effector cell.

16. The multifunctional molecule of embodiment 15, wherein the immune cell engager binds to, but does not activate, an immune cell, e.g., an effector cell.

17. The multifunctional molecule of any one of embodiments 14-16, wherein the immune cell engager is a T cell engager, e.g., a T cell engager that mediates binding to and activation of a T cell, or a T cell engager that mediates binding to but not activation of a T cell.

18. The multifunctional molecule of embodiment 17, wherein the T cell engager binds to TCRα, TCRβ, TCRγ, TCRζ, ICOS, CD28, CD27, HVEM, LIGHT, CD40, 4-1BB, OX40, DR3, GITR, CD30, TIM1, SLAM, CD2, or CD226, e.g., the T cell engager is an anti-TCRβ antibody molecule.

19. The multifunctional molecule of any one of embodiments 14-16, wherein the immune cell engager is an NK cell engager, e.g., an NK cell engager that mediates binding to and activation of an NK cell, or an NK cell engager that mediates binding to but not activation of an NK cell.

20. The multifunctional molecule of embodiment 19, wherein the NK cell engager is chosen from an antibody molecule, e.g., an antigen binding domain, or ligand that binds to (e.g., activates): NKp30, NKp40, NKp44, NKp46, NKG2D, DNAM1, DAP10, CD16 (e.g., CD16a, CD16b, or both), CRTAM, CD27, PSGL1, CD96, CD100 (SEMA4D), NKp80, CD244 (also known as SLAMF4 or 2B4), SLAMF6, SLAMF7, KIR2DS2, KIR2DS4, KIR3DS1, KIR2DS3, KIR2DS5, KIR2DS1, CD94, NKG2C, NKG2E, or CD160, e.g., the NK cell engager is an antibody molecule or ligand that binds to (e.g., activates) NKp30.

21. The multifunctional molecule of embodiment 19, wherein the NK cell engager is an antibody molecule, e.g., an antigen binding domain.

22. The multifunctional molecule of either of embodiments 20 or 21, wherein the NK cell engager is capable of engaging an NK cell.

23. The multifunctional molecule of any one of embodiments 19-22, wherein the NK cell engager is an antibody molecule, e.g., an antigen binding domain, that binds to NKp30, NKp46, NKG2D, or CD16.

24. The multifunctional molecule of any preceding embodiment, wherein the multifunctional molecule:

(i) binds specifically to an epitope of NKp30, NKp46, NKG2D, or CD16, e.g., the same or similar epitope as the epitope recognized by an anti-NKp30, anti-NKp46, anti-NKG2D, or anti-CD16 antibody molecule as described herein;

(ii) shows the same or similar binding affinity or specificity, or both, as an anti-NKp30, anti-NKp46, anti-NKG2D, or anti-CD16 antibody molecule as described herein;

(iii) inhibits, e.g., competitively inhibits, the binding of an anti-NKp30, anti-NKp46, anti-NKG2D, or anti-CD16 antibody molecule as described herein;

(iv) binds the same or an overlapping epitope with an anti-NKp30, anti-NKp46, anti-NKG2D, or anti-CD16 antibody molecule as described herein; or (v) competes for binding, and/or binds the same epitope, with an anti-NKp30, anti-NKp46, anti-NKG2D, or anti-CD16 molecule as described herein.

25. The multifunctional molecule of any of embodiments 19-24, wherein the anti-NKp30, anti-NKp46, anti-NKG2D, or anti-CD16 antibody molecule comprises one or more CDRs, framework regions, variable domains, heavy or light chains, or an antigen binding domain chosen from Table 16, Table 17, Table 20A or Table 20B, Table 21A or Table 21B, Table 22, Table 23A or Table 23B, Table 24, Table 25, Table 26, or Table 27, or a sequence substantially identical thereto.

26. The multifunctional molecule of any of embodiments 19-25, wherein the NK cell engager is an antibody molecule, e.g., an antigen binding domain, that binds to NKp30.

27. The multifunctional molecule of any of embodiments 19-26, wherein lysis of the lymphoma cell or lymphocyte is mediated by NKp30.

28. The multifunctional molecule of any of embodiments 19-27, wherein the multifunctional molecule does not activate the NK cell when incubated with the NK cell in the absence of the tumor antigen on the lymphoma cell or TRBC1 or TRBC2 on the lymphocyte.

29. The multifunctional molecule of any of embodiments 19-28, wherein the multifunctional molecule activates the NK cell when the NK cell is a NKp30 expressing NK cell and either: (1) the tumor antigen on the lymphoma cell is also present or (2) TRBC1 or TRBC2 on the lymphocyte is also present.

30. The multifunctional molecule of any of embodiments 19-29, wherein the multifunctional molecule does not activate the NK cell when the NK cell is not a NKp30 expressing NK cell and either: (1) the tumor antigen on the lymphoma cell is also present or (2) TRBC1 or TRBC2 on the lymphocyte is also present.

31. The multifunctional molecule of any of embodiments 19-30, wherein the NK cell engager comprises an anti-NKp30 antigen binding domain disclosed herein, e.g., comprises one or more CDRs, framework regions, variable regions, or antigen binding domains disclosed in any of Table 20A or Table 20B, Table 22, Table 23A or Table 23B, Table 24, Table 25, Table 26, Table 21A or Table 21B, and Table 17 or a sequence having at least 85%, 90%, 95%, or 99% identity thereto.

32. The multifunctional molecule of any of embodiments 19-25, wherein the NK cell engager is an antibody molecule, e.g., an antigen binding domain, that binds to NKp46.

33. The multifunctional molecule of embodiment 32, wherein lysis of the lymphoma cell is mediated by NKp46.

34. The multifunctional molecule of either of embodiments 32 or 33, wherein the multifunctional molecule does not activate the NK cell when incubated with the NK cell in the absence of the tumor antigen on the lymphoma cell.

35. The multifunctional molecule of any one of embodiments 32-34, wherein the multifunctional molecule activates the NK cell when the NK cell is a NKp46 expressing NK cell and the tumor antigen on the lymphoma cell is also present.

36. The multifunctional molecule of any one of embodiments 32-35, wherein the multifunctional molecule does not activate the NK cell when the NK cell is not a NKp46 expressing NK cell and the tumor antigen on the lymphoma cell is also present.

37. The multifunctional molecule of any one of embodiments 32-36, wherein the NK cell engager comprises a VH comprising the amino acid sequence of SEQ ID NO: 6182 (or an amino acid sequence having at least about 75%, 80%, 85%, 90%, 95%, or 99% sequence identity to SEQ ID NO: 6182).

38. The multifunctional molecule of any one of embodiments 32-37, wherein the NK cell engager comprises a VL comprising the amino acid sequence of SEQ ID NO: 6183 (or an amino acid sequence having at least about 93%, 95%, or 99% sequence identity to SEQ ID NO: 6183).

39. The multifunctional molecule of 32-38, wherein the NK cell engager comprises an scFV comprising the amino acid sequence of SEQ ID NO: 6181 (or an amino acid sequence having at least about 93%, 95%, or 99% sequence identity to SEQ ID NO: 6181).

40. The multifunctional molecule of any of embodiments 19-25, wherein the NK cell engager is an antibody molecule, e.g., an antigen binding domain, that binds to NKG2D.

41. The multifunctional molecule of embodiment 40, wherein lysis of the lymphoma cell is mediated by NKG2D.

42. The multifunctional molecule of either of embodiments 40 or 41, wherein the multifunctional molecule does not activate the NK cell when incubated with the NK cell in the absence of the tumor antigen on the lymphoma cell.

43. The multifunctional molecule of any one of embodiments 40-42, wherein the multifunctional molecule activates the NK cell when the NK cell is a NKG2D expressing NK cell and the tumor antigen on the lymphoma cell is also present.

44. The multifunctional molecule of any one of embodiments 40-43, wherein the multifunctional molecule does not activate the NK cell when the NK cell is not a NKG2D expressing NK cell and the tumor antigen on the lymphoma cell is also present.

45. The multifunctional molecule of any one of embodiments 40-44, wherein the NK cell engager comprises a VH comprising the amino acid sequence of SEQ ID NO: 6176 (or an amino acid sequence having at least about 75%, 80%, 85%, 90%, 95%, or 99% sequence identity to SEQ ID NO: 6176).

46. The multifunctional molecule of any one of embodiments 40-45, wherein the NK cell engager comprises a VL comprising the amino acid sequence of SEQ ID NO: 6177 (or an amino acid sequence having at least about 93%, 95%, or 99% sequence identity to SEQ ID NO: 6177).

47. The multifunctional molecule of any of embodiments 40-46, wherein the NK cell engager comprises an scFV comprising the amino acid sequence of SEQ ID NO: 6175 (or an amino acid sequence having at least about 93%, 95%, or 99% sequence identity to SEQ ID NO: 6175).

48. The multifunctional molecule of any one of embodiments 40-44, wherein the NK cell engager comprises a VH comprising the amino acid sequence of SEQ ID NO: 6179 (or an amino acid sequence having at least about 75%, 80%, 85%, 90%, 95%, or 99% sequence identity to SEQ ID NO: 6179).

49. The multifunctional molecule of anyone of embodiments 40-44 or 48, wherein the NK cell engager comprises a VL comprising the amino acid sequence of SEQ ID NO: 6180 (or an amino acid sequence having at least about 93%, 95%, or 99% sequence identity to SEQ ID NO: 6180).

50. The multifunctional molecule of any of embodiments 40-44, 48, or 49, wherein the NK cell engager comprises an scFV comprising the amino acid sequence of SEQ ID NO: 6178 (or an amino acid sequence having at least about 93%, 95%, or 99% sequence identity to SEQ ID NO: 6178).

51. The multifunctional molecule of any of embodiments 19-25, wherein the NK cell engager is an antibody molecule, e.g., an antigen binding domain, that binds to CD16.

52. The multifunctional molecule of embodiment 51, wherein lysis of the lymphoma cell is mediated by CD16.

53. The multifunctional molecule of either of embodiments 51 or 52, wherein the multifunctional molecule does not activate the NK cell when incubated with the NK cell in the absence of the tumor antigen on the lymphoma cell.

54. The multifunctional molecule of any one of embodiments 51-53, wherein the multifunctional molecule activates the NK cell when the NK cell is a CD16 expressing NK cell and the tumor antigen on the lymphoma cell is also present.

55. The multifunctional molecule of any one of embodiments 51-54, wherein the multifunctional molecule does not activate the NK cell when the NK cell is not a CD16 expressing NK cell and the tumor antigen on the lymphoma cell is also present.

56. The multifunctional molecule of any one of embodiments 51-55, wherein the NK cell engager comprises a VH comprising the amino acid sequence of SEQ ID NO: 6185 (or an amino acid sequence having at least about 75%, 80%, 85%, 90%, 95%, or 99% sequence identity to SEQ ID NO: 6185).

57. The multifunctional molecule of any one of embodiments 51-56, wherein the NK cell engager comprises a VL comprising the amino acid sequence of SEQ ID NO: 6186 (or an amino acid sequence having at least about 93%, 95%, or 99% sequence identity to SEQ ID NO: 6186).

58. The multifunctional molecule of any of embodiments 51-57, wherein the NK cell engager comprises an scFV comprising the amino acid sequence of SEQ ID NO: 6184 (or an amino acid sequence having at least about 93%, 95%, or 99% sequence identity to SEQ ID NO: 6184).

59. The multifunctional molecule of embodiment 19, wherein the NK cell engager is a ligand, optionally, the ligand further comprises an immunoglobulin constant region, e.g., an Fc region.

60. The multifunctional molecule of embodiment 59, wherein the NK cell engager is a ligand of NKp44 or NKp46, e.g., a viral HA.

61. The multifunctional molecule of embodiment 59, wherein the NK cell engager is a ligand of DAP10, e.g., a coreceptor for NKG2D.

62. The multifunctional molecule of embodiment 59, wherein the NK cell engager is a ligand of CD16, e.g., a CD16a/b ligand, e.g., a CD16a/b ligand further comprising an antibody Fc region.

63. The multifunctional molecule of any one of embodiments 14-16, wherein the immune cell engager mediates binding to, or activation of, or both of, one or more of a B cell, a macrophage, and/or a dendritic cell.

64. The multifunctional molecule of embodiment 63, wherein the immune cell engager comprises a B cell, macrophage, and/or dendritic cell engager chosen from one or more of CD40 ligand (CD40L) or a CD70 ligand; an antibody molecule that binds to CD40 or CD70; an antibody molecule to OX40; an OX40 ligand (OX40L); an agonist of a Toll-like receptor (e.g., a TLR4, e.g., a constitutively active TLR4 (caTLR4) or a TLR9 agonist); a 41BB; a CD2 agonist; a CD47; or a STING agonist, or a combination thereof.

65. The multifunctional molecule of any one of embodiments 14-16, wherein the immune cell engager is a B cell engager, e.g., a CD40L, an OX40L, or a CD70 ligand, or an antibody molecule that binds to OX40, CD40 or CD70.

66. The multifunctional molecule of any one of embodiments 14-16, wherein the immune cell engager is a macrophage cell engager, e.g., a CD2 agonist; a CD40L; an OX40L; an antibody molecule that binds to OX40, CD40 or CD70; an agonist of a Toll-like receptor (TLR) (e.g., a TLR4, e.g., a constitutively active TLR4 (caTLR4) or a TLR9 agonist); CD47; or a STING agonist.

67. The multifunctional molecule of any one of embodiments 14-16, wherein the immune cell engager is a dendritic cell engager, e.g., a CD2 agonist, an OX40 antibody, an OX40L, 41BB agonist, a Toll-like receptor agonist or a fragment thereof (e.g., a TLR4, e.g., a constitutively active TLR4 (caTLR4)), CD47 agonist, or a STING agonist.

68. The multifunctional molecule of embodiment 66 or 67, wherein the STING agonist comprises a cyclic dinucleotide, e.g., a cyclic di-GMP (cdGMP), a cyclic di-AMP (cdAMP), or a combination thereof, optionally with 2',5' or 3',5' phosphate linkages, e.g., wherein the STING agonist is covalently coupled to the multifunctional molecule.

69. The multifunctional molecule of any one of embodiments 1-13, wherein the multifunctional molecule comprises a cytokine molecule.

70. The multifunctional molecule of embodiment 69, wherein the cytokine molecule is chosen from interleukin-2 (IL-2), interleukin-7 (IL-7), interleukin-12 (IL-12), interleukin-15 (IL-15), interleukin-18 (IL-18), interleukin-21 (IL-21), or interferon gamma, or a fragment or variant thereof, or a combination of any of the aforesaid cytokines.

71. The multifunctional molecule of embodiment 70, wherein the cytokine molecule is interleukin-2 (IL-2).

72. The multifunctional molecule of any of embodiments 69-71, wherein the cytokine molecule is a monomer or a dimer.

73. The multifunctional molecule of any one of embodiments 69-72, wherein the cytokine molecule further comprises a receptor dimerizing domain, e.g., an IL15Ralpha dimerizing domain.

74. The multifunctional molecule of embodiment 73, wherein the cytokine molecule (e.g., IL-15) and the receptor dimerizing domain (e.g., an IL15Ralpha dimerizing domain) are not covalently linked, e.g., are non-covalently associated.

75. The multifunctional molecule of any of embodiments 1-13, wherein the multifunctional molecule comprises a cytokine inhibitor molecule.

76. The multifunctional molecule of embodiment 75, wherein the cytokine inhibitor molecule is a TGF-beta inhibitor.

77. The multifunctional molecule of either of embodiments 75 or 76, wherein the TGF-beta inhibitor inhibits (e.g., reduces the activity of): (i) TGF-beta 1; (ii) TGF-beta 2; (iii) TGF-beta 3; (iv) (i) and (ii); (v) (i) and (iii); (vi) (ii) and (iii); or (vii) (i), (ii), and (iii).

78. The multifunctional molecule of any of embodiments 75-77, wherein the TGF-beta inhibitor comprises a portion of a TGF-beta receptor (e.g., an extracellular domain of a TGF-beta receptor) that is capable of inhibiting (e.g., reducing the activity of) TGF-beta, or functional fragment or variant thereof.

79. The multifunctional molecule of embodiment 78, wherein the TGF-beta inhibitor comprises a portion of (i) TGFBR1; (ii) TGFBR2; (iii) TGFBR3; (iv) (i) and (ii); (v) (i) and (iii); (vi) (ii) and (iii); or (vii) (i), (ii), and (iii).

80. The multifunctional molecule of any of embodiments 75-79, wherein the TGF-beta inhibitor comprises an amino acid sequence selected from Table 19, or an amino acid sequence having at least about 93%, 95%, or 99% sequence identity thereto.

81. The multifunctional molecule of any of embodiments 1-13, wherein the multifunctional molecule comprises a death receptor signal engager chosen from a TNF-related apoptosis-inducing ligand (TRAIL) molecule, a death receptor molecule, or an antigen binding domain that specifically binds to a death receptor.

82. The multifunctional molecule of embodiment 81, wherein the death receptor signal engager activates death receptor signaling in the lymphoma cell (e.g., T cell) or lymphocyte expressing TRBC1 or TRBC2, e.g., and induces apoptosis or cell death in said cell.

83. The multifunctional molecule of either of embodiments 81 or 82, wherein the death receptor signal engager does not activate death receptor signaling on non-lymphoma cells and lymphocytes not expressing TRBC1 or not expressing TRBC2.

84. The multifunctional molecule of any of embodiments 81-83, wherein the death receptor signal engager comprises a TRAIL molecule, e.g., one or more TRAIL polypeptides or a fragment thereof.

85. The multifunctional molecule of embodiment 84, wherein the TRAIL molecule specifically binds to Death Receptor 4 (DR4) or Death Receptor 5 (DR5).

86. The multifunctional molecule of either of embodiments 84 or 85, wherein the TRAIL molecule comprises a truncated TRAIL polypeptide, e.g., relative to a wild-type TRAIL polypeptide.

87. The multifunctional molecule of embodiment 86, wherein the TRAIL molecule comprises at least residues corresponding to amino acids 95-281 of human TRAIL, e.g., a truncated TRAIL molecule comprising residues corresponding to amino acids 95-281 of human TRAIL.

88. The multifunctional molecule of embodiment 87, wherein the TRAIL molecule comprises a truncated TRAIL polypeptide comprising amino acids 95-281 of human TRAIL, e.g., and not amino acids 1-94 of human TRAIL.

89. The multifunctional molecule of embodiment 86, wherein the TRAIL molecule comprises at least residues corresponding to amino acids 122-281 of human TRAIL, e.g., a truncated TRAIL molecule comprising residues corresponding to amino acids 122-281 of human TRAIL.

90. The multifunctional molecule of embodiment 89, wherein the TRAIL molecule comprises a truncated TRAIL polypeptide comprising amino acids 122-281 of human TRAIL, e.g., and not amino acids 1-121 of human TRAIL.

91. The multifunctional molecule of any of embodiments 84-90, wherein the death receptor signal engager comprises one, two, or three TRAIL molecules.

92. The multifunctional molecule of any of embodiments 81-83, wherein the death receptor signal engager comprises an antigen binding domain that specifically binds to a death receptor, e.g., Death Receptor 4 (DR4) or Death Receptor 5 (DR5).

93. The multifunctional molecule of embodiment 92, wherein the death receptor signal engager comprises one, two, or three antigen binding domains that specifically binds to a death receptor.

94. The multifunctional molecule of either of embodiments 92 or 93, wherein the antigen binding domain that specifically binds to a death receptor binds to DR5.

95. The multifunctional molecule of any of embodiments 92-94, wherein the antigen binding domain that specifically binds to a death receptor comprises tigatuzumab, drozitumab, or conatumumab.

96. The multifunctional molecule of any of embodiments 81-95, wherein the death receptor signal engager comprises an amino acid sequence selected from Table 28, or an amino acid sequence having at least about 75%, 80%, 85%, 90%, 95%, or 99% sequence identity thereto.

97. The multifunctional molecule of any of embodiments 81-96, wherein the death receptor signal engager comprises an amino acid sequence of SEQ ID NO: 6157, or an amino acid sequence having at least about 75%, 80%, 85%, 90%, 95%, or 99% sequence identity thereto.

98. The multifunctional molecule of any of embodiments 81-96, wherein the death receptor signal engager comprises an amino acid sequence of SEQ ID NO: 6158, or an amino acid sequence having at least about 75%, 80%, 85%, 90%, 95%, or 99% sequence identity thereto.

99. The multifunctional molecule of any of embodiments 81-96, wherein the death receptor signal engager comprises an amino acid sequence of SEQ ID NO: 6159, or an amino acid sequence having at least about 75%, 80%, 85%, 90%, 95%, or 99% sequence identity thereto.

100. The multifunctional molecule of any of embodiments 81-96, wherein the death receptor signal engager comprises an amino acid sequence of SEQ ID NO: 6160, or an amino acid sequence having at least about 75%, 80%, 85%, 90%, 95%, or 99% sequence identity thereto.

101. The multifunctional molecule of any of embodiments 81-96, wherein the death receptor signal engager comprises an amino acid sequence of SEQ ID NO: 6161, or an amino acid sequence having at least about 75%, 80%, 85%, 90%, 95%, or 99% sequence identity thereto.

102. The multifunctional molecule of any of embodiments 81-96, wherein the death receptor signal engager comprises an amino acid sequence of SEQ ID NO: 6162, or an amino acid sequence having at least about 75%, 80%, 85%, 90%, 95%, or 99% sequence identity thereto.

103. The multifunctional molecule of any of embodiments 81-96, wherein the death receptor signal engager comprises an amino acid sequence of SEQ ID NO: 6163, or an amino acid sequence having at least about 75%, 80%, 85%, 90%, 95%, or 99% sequence identity thereto.

104. The multifunctional molecule of any of embodiments 81-96, wherein the death receptor signal engager comprises an amino acid sequence of SEQ ID NO: 6164, or an amino acid sequence having at least about 75%, 80%, 85%, 90%, 95%, or 99% sequence identity thereto.

105. The multifunctional molecule of any of embodiments 81-96, wherein the death receptor signal engager comprises an amino acid sequence of SEQ ID NO: 6165, or an amino acid sequence having at least about 75%, 80%, 85%, 90%, 95%, or 99% sequence identity thereto.

106. The multifunctional molecule of embodiment 18, wherein the T cell engager binds to TCRβ, e.g., to TCR beta V chain (TCRβV).

107. The multifunctional molecule of embodiment 106, wherein the T cell engager comprises an antigen binding domain (e.g., an antibody molecule or fragment thereof) that binds to (e.g., and in some embodiments activates) TCRβ.

108. The multifunctional molecule of either of embodiments 106 or 107, wherein the T cell engager comprises an anti-TCRβV antibody molecule, e.g., that specifically binds to a human TCR beta V chain (TCRβV).

109. The multifunctional molecule of any of embodiments 106-108, wherein the T cell engager does not bind to the lymphoma cell or the lymphocyte expressing TRBC1 or TRBC2.

110. The multifunctional molecule of any of embodiments 106-108, wherein the T cell engager is capable of binding to or binds to the lymphoma cell or the lymphocyte expressing TRBC1 or TRBC2.

111. The multifunctional molecule of any of embodiments 106-110, wherein the T cell engager does not activate the lymphoma cell or the lymphocyte expressing TRBC1 or TRBC2.

112. The multifunctional molecule of any of embodiments 106-111, wherein the T cell engager comprises an anti-TCRβV antibody molecule that specifically binds to a TCRβV subfamily or subfamily member of Table 29.

113. The multifunctional molecule of embodiment 112, wherein the anti-TCRβV antibody molecule specifically binds to TCRβ V6, e.g., a TCRβ V6 subfamily comprising: TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01.

114. The multifunctional molecule of embodiment 113, wherein the anti-TCRβV antibody molecule comprises one or more CDRs, framework regions, or variable heavy and/or light chain regions provided in Table 30 or having at least about 93%, 95%, or 99% sequence identity thereto.

115. The multifunctional molecule of embodiment 112, wherein the anti-TCRβV antibody molecule specifically binds to TCRβ V12, e.g., a TCRβ V12 subfamily comprising: TCRβ V12-4*01, TCRβ V12-3*01 or TCRβ V12-5*01.

116. The multifunctional molecule of embodiment 115, wherein the anti-TCRβV antibody molecule comprises one or more CDRs, framework regions, or variable heavy and/or light chain regions provided in Table 31 or having at least about 93%, 95%, or 99% sequence identity thereto.

117. The multifunctional molecule of any one of embodiments 1-13, wherein the multifunctional molecule comprises a stromal modifying moiety.

118. The multifunctional molecule of embodiment 117, wherein the stromal modifying moiety causes one or more of: decreases the level or production of a stromal or extracellular matrix (ECM) component; decreases tumor fibrosis; increases interstitial tumor transport; improves tumor perfusion; expands the tumor microvasculature; decreases interstitial fluid pressure (IFP) in a tumor; or decreases or enhances penetration or diffusion of an agent, e.g., a cancer therapeutic or a cellular therapy, into a tumor or tumor vasculature.

119. The multifunctional molecule of embodiment 118, wherein the stromal or ECM component decreased is chosen from a glycosaminoglycan or an extracellular protein, or a combination thereof.

120. The multifunctional molecule of any one of embodiments 1-119, wherein the multifunctional molecule comprises:

(i) an immune cell engager (e.g., a T cell engager, an NK cell engager, a B cell engager, a dendritic cell engager, or a macrophage cell engager) and a cytokine molecule, (ii) an immune cell engager (e.g., a T cell engager, an NK cell engager, a B cell engager, a dendritic cell engager, or a macrophage cell engager) and a cytokine inhibitor molecule, (iii) an immune cell engager (e.g., a T cell engager, an NK cell engager, a B cell engager, a dendritic cell engager, or a macrophage cell engager) and a death receptor signal engager, (iv) an immune cell engager (e.g., a T cell engager, an NK cell engager, a B cell engager, a dendritic cell engager, or a macrophage cell engager) and a stromal modifying moiety, (v) a cytokine molecule and a stromal modifying moiety, (vi) a cytokine molecule and a death receptor signal engager, (vii) a cytokine inhibitor molecule and a stromal modifying moiety, (viii) a cytokine inhibitor molecule and a death receptor signal engager, (ix) an immune cell engager (e.g., a T cell engager, an NK cell engager, a B cell engager, a dendritic cell engager, or a macrophage cell engager), a cytokine molecule, a death receptor signal engager, and a stromal modifying moiety, or (x) an immune cell engager (e.g., a T cell engager, an NK cell engager, a B cell engager, a dendritic cell engager, or a macrophage cell engager), a cytokine inhibitor molecule, a death receptor signal engager, and a stromal modifying moiety.

121. The multifunctional molecule of any one of embodiments 1-120, wherein the multifunctional molecule comprises the following configuration:

A, B-[dimerization module]-C, -D, wherein:

(a) the dimerization module comprises an immunoglobulin constant domain, e.g., a heavy chain constant domain (e.g., a homodimeric or heterodimeric heavy chain constant region, e.g., an Fc region), or a constant domain of an immunoglobulin variable region (e.g., a Fab region); and (b) A, B, C, and D are independently absent; (i) an antigen binding domain that preferentially binds to TRBC1 or TRBC2; (ii) an immune cell engager chosen from a T cell engager, an NK cell engager, a B cell engager, a dendritic cell engager, or a macrophage cell engager; (iii) a cytokine molecule or cytokine inhibitor molecule; (iv) a death receptor signal engager; or (v) a stromal modifying moiety, provided that:

at least one, two, or three of A, B, C, and D comprises an antigen binding domain that preferentially binds to TRBC1 or TRBC2, and any of the remaining A, B, C, and D is absent or comprises one of an immune cell engager, a cytokine molecule, a cytokine inhibitor molecule, a death receptor signal engager, or a stromal modifying moiety.

122. The multifunctional molecule of embodiment 121, wherein:

(1) A comprises an antigen binding domain that preferentially binds to a T cell receptor comprising TRBC1 or TRBC2, and B, C, or D comprises an immune cell engager, e.g., a T cell engager, e.g., an anti-TCRβV antibody molecule;

(2) A comprises an antigen binding domain that preferentially binds to TRBC1 or TRBC2, and B, C, or D comprises an immune cell engager, e.g., an NK cell engager, e.g., an anti-NKp30 or anti-NKp46 antibody molecule;

(3) A comprises an antigen binding domain that preferentially binds to TRBC1 or TRBC2, and B, C, or D comprises a cytokine molecule;

(4) A comprises an antigen binding domain that preferentially binds to TRBC1 or TRBC2, and B, C, or D comprises a cytokine inhibitor molecule;

(5) A comprises an antigen binding domain that preferentially binds to TRBC1 or TRBC2, and B, C, or D comprises a death receptor signal engager;

(6) A comprises an antigen binding domain that preferentially binds to TRBC1 or TRBC2, and B, C, or D comprises a stromal modifying moiety;

(7) A comprises a first antigen binding domain that binds to a TRBC1 or TRBC2, B comprises a second antigen binding domain that preferentially binds to TRBC1 or TRBC2, and C or D comprises an immune cell engager, e.g., a T cell engager, e.g., an anti-TCRβV antibody molecule;

(8) A comprises a first antigen binding domain that binds to TRBC1 or TRBC2, B comprises a second antigen binding domain that preferentially binds to TRBC1 or TRBC2, and C or D comprises an immune cell engager, e.g., an NK cell engager, e.g., an anti-NKp30, anti-NKp46, anti-NKG2D, or anti-CD16 antibody molecule;

(9) A comprises a first antigen binding domain that preferentially binds to TRBC1 or TRBC2, B comprises a second antigen binding domain that preferentially binds to TRBC1 or TRBC2, and C or D comprises a cytokine molecule;

(10) A comprises a first antigen binding domain that preferentially binds to TRBC1 or TRBC2, B comprises a second antigen binding domain that preferentially binds to TRBC1 or TRBC2, and C or D comprises a cytokine inhibitor molecule;

(11) A comprises a first antigen binding domain that preferentially binds to TRBC1 or TRBC2, B comprises a second antigen binding domain that preferentially binds to TRBC1 or TRBC2, and C or D comprises a death receptor signal engager;

(12) A comprises a first antigen binding domain that preferentially binds to TRBC1 or TRBC2, B comprises a second antigen binding domain that preferentially binds to TRBC1 or TRBC2, and C or D comprises a stromal modifying moiety;

(13) A comprises a first antigen binding domain that preferentially binds to TRBC1 or TRBC2, C comprises a second antigen binding domain that preferentially binds to TRBC1 or TRBC2, and B or D comprises an immune cell engager, e.g., a T cell engager, e.g., an anti-TCRβV antibody molecule;

(14) A comprises a first antigen binding domain that preferentially binds to TRBC1 or TRBC2, C comprises a second antigen binding domain that preferentially binds to TRBC1 or TRBC2, and B or D comprises an immune cell engager, e.g., an NK cell engager, e.g., an anti-NKp30, anti-NKp46, anti-NKG2D, or anti-CD16 antibody molecule;

(15) A comprises a first antigen binding domain that preferentially binds to TRBC1 or TRBC2, C comprises a second antigen binding domain that preferentially binds to TRBC1 or TRBC2, and B or D comprises a cytokine molecule;

(16) A comprises a first antigen binding domain that preferentially binds to TRBC1 or TRBC2, C comprises a second antigen binding domain that preferentially binds to TRBC1 or TRBC2, and B or D comprises a cytokine inhibitor molecule;

(17) A comprises a first antigen binding domain that preferentially binds to TRBC1 or TRBC2, C comprises a second antigen binding domain that preferentially binds to TRBC1 or TRBC2, and B or D comprises a death receptor signal engager;

(18) A comprises a first antigen binding domain that preferentially binds to TRBC1 or TRBC2, C comprises a second antigen binding domain that preferentially binds to TRBC1 or TRBC2, and B or D comprises a stromal modifying moiety;

(19) A comprises a first antigen binding domain that preferentially binds to TRBC1 or TRBC2, and B, C, or D comprises (a) an immune cell engager, e.g., an NK cell engager, e.g., an anti-NKp30, anti-NKp46, anti-NKG2D, or anti-CD16 antibody molecule, and (b) a cytokine molecule;

(20) A comprises a first antigen binding domain that preferentially binds to TRBC1 or TRBC2, and B, C, or D comprises (a) an immune cell engager, e.g., an NK cell engager, e.g., an anti-NKp30, anti-NKp46, anti-NKG2D, or anti-CD16 antibody molecule, and (b) a cytokine inhibitor molecule;

(21) A comprises a first antigen binding domain that preferentially binds to TRBC1 or TRBC2, and B, C, or D comprises (a) an immune cell engager, e.g., an NK cell engager, e.g., an anti-NKp30, anti-NKp46, anti-NKG2D, or anti-CD16 antibody molecule, and (b) a death receptor signal engager;

(22) A comprises a first antigen binding domain that preferentially binds to TRBC1 or TRBC2, and B, C, or D comprises (a) an immune cell engager, e.g., an NK cell engager, e.g., an anti-NKp30, anti-NKp46, anti-NKG2D, or anti-CD16 antibody molecule, and (b) a stromal modifying moiety;

(23) A comprises a first antigen binding domain that preferentially binds to TRBC1 or TRBC2, and B, C, or D comprises (a) an immune cell engager, e.g., a T cell engager, e.g., an anti-TCRβV antibody molecule, and (b) a cytokine molecule;

(24) A comprises a first antigen binding domain that preferentially binds to TRBC1 or TRBC2, and B, C, or D comprises (a) an immune cell engager, e.g., a T cell engager, e.g., an anti-TCRβV antibody molecule, and (b) a cytokine inhibitor molecule;

(25) A comprises a first antigen binding domain that preferentially binds to TRBC1 or TRBC2, and B, C, or D comprises (a) an immune cell engager, e.g., a T cell engager, e.g., an anti-TCRβV antibody molecule, and (b) a death receptor signal engager;

(26) A comprises a first antigen binding domain that preferentially binds to TRBC1 or TRBC2, and B, C, or D comprises (a) an immune cell engager, e.g., a T cell engager, e.g., an anti-TCRβV antibody molecule, and (b) a stromal modifying moiety;

(27) A comprises a first antigen binding domain that preferentially binds to TRBC1 or TRBC2, and B, C, or D comprises (a) a cytokine molecule and (b) a stromal modifying moiety;

(28) A comprises a first antigen binding domain that preferentially binds to TRBC1 or TRBC2, and B, C, or D comprises (a) a cytokine molecule and (b) a death receptor signal engager;

(29) A comprises a first antigen binding domain that preferentially binds to TRBC1 or TRBC2, and B, C, or D comprises (a) a cytokine inhibitor molecule and (b) a stromal modifying moiety;

(30) A comprises a first antigen binding domain that preferentially binds to TRBC1 or TRBC2, and B, C, or D comprises (a) a cytokine inhibitor molecule and (b) a death receptor signal engager;

(31) A comprises a first antigen binding domain that preferentially binds to TRBC1 or TRBC2, and B, C, or D comprises (a) a death receptor signal engager and (b) a stromal modifying moiety;

(32) A comprises a first antigen binding domain that preferentially binds to TRBC1 or TRBC2, B comprises a second antigen binding domain that preferentially binds to TRBC1 or TRBC2, and C or D comprises (a) an immune cell engager, e.g., an NK cell engager, e.g., an anti-NKp30, anti-NKp46, anti-NKG2D, or anti-CD16 antibody molecule, and (b) a cytokine molecule;

(33) A comprises a first antigen binding domain that preferentially binds to TRBC1 or TRBC2, B comprises a second antigen binding domain that preferentially binds to TRBC1 or TRBC2, and C or D comprises (a) an immune cell engager, e.g., an NK cell engager, e.g., an anti-NKp30, anti-NKp46, anti-NKG2D, or anti-CD16 antibody molecule, and (b) a cytokine inhibitor molecule;

(34) A comprises a first antigen binding domain that preferentially binds to TRBC1 or TRBC2, B comprises a second antigen binding domain that preferentially binds to TRBC1 or TRBC2, and C or D comprises (a) an immune cell engager, e.g., an NK cell engager, e.g., an anti-NKp30, anti-NKp46, anti-NKG2D, or anti-CD16 antibody molecule, and (b) a death receptor signal engager;

(35) A comprises a first antigen binding domain that preferentially binds to TRBC1 or TRBC2, B comprises a second antigen binding domain that preferentially binds to TRBC1 or TRBC2, and C or D comprises (a) an immune cell engager, e.g., an NK cell engager, e.g., an anti-NKp30, anti-NKp46, anti-NKG2D, or anti-CD16 antibody molecule, and (b) a stromal modifying moiety;

(36) A comprises a first antigen binding domain that preferentially binds to TRBC1 or TRBC2, B comprises a second antigen binding domain that preferentially binds to TRBC1 or TRBC2, and C or D comprises (a) an immune cell engager, e.g., a T cell engager, e.g., an anti-TCRβV antibody molecule, and (b) a cytokine molecule;

(37) A comprises a first antigen binding domain that preferentially binds to TRBC1 or TRBC2, B comprises a second antigen binding domain that preferentially binds to TRBC1 or TRBC2, and C or D comprises (a) an immune cell engager, e.g., a T cell engager, e.g., an anti-TCRβV antibody molecule, and (b) a cytokine inhibitor molecule;

(38) A comprises a first antigen binding domain that preferentially binds to TRBC1 or TRBC2, B comprises a second antigen binding domain that preferentially binds to TRBC1 or TRBC2, and C or D comprises (a) an immune cell engager, e.g., a T cell engager, e.g., an anti-TCRβV antibody molecule, and (b) a death receptor signal engager;

(39) A comprises a first antigen binding domain that preferentially binds to TRBC1 or TRBC2, B comprises a second antigen binding domain that preferentially binds to TRBC1 or TRBC2, and C or D comprises (a) an immune cell engager, e.g., a T cell engager, e.g., an anti-TCRβV antibody molecule, and (b) a stromal modifying moiety;

(40) A comprises a first antigen binding domain that preferentially binds to TRBC1 or TRBC2, B comprises a second antigen binding domain that preferentially binds to TRBC1 or TRBC2, and C or D comprises (a) a cytokine molecule and (b) a stromal modifying moiety; e.g. CD137;

(41) A comprises a first antigen binding domain that preferentially binds to TRBC1 or TRBC2, B comprises a second antigen binding domain that preferentially binds to TRBC1 or TRBC2, and C or D comprises (a) a cytokine molecule and (b) a death receptor signal engager;

(42) A comprises a first antigen binding domain that preferentially binds to TRBC1 or TRBC2, B comprises a second antigen binding domain that preferentially binds to TRBC1 or TRBC2, and C or D comprises (a) a cytokine inhibitor molecule and (b) a stromal modifying moiety;

(43) A comprises a first antigen binding domain that preferentially binds to TRBC1 or TRBC2, B comprises a second antigen binding domain that preferentially binds to TRBC1 or TRBC2, and C or D comprises (a) a cytokine inhibitor molecule and (b) a death receptor signal engager;

(44) A comprises a first antigen binding domain that preferentially binds to TRBC1 or TRBC2, B comprises a second antigen binding domain that preferentially binds to TRBC1 or TRBC2, and C or D comprises (a) a stromal modifying moiety and (b) a death receptor signal engager;

(45) A comprises a first antigen binding domain that preferentially binds to TRBC1 or TRBC2, C comprises a second antigen binding domain that preferentially binds to TRBC1 or TRBC2, and B or D comprises (a) an immune cell engager, e.g., an NK cell engager, e.g., an anti-NKp30, anti-NKp46, anti-NKG2D, or anti-CD16 antibody molecule, and (b) a cytokine molecule;

(46) A comprises a first antigen binding domain that preferentially binds to TRBC1 or TRBC2, C comprises a second antigen binding domain that preferentially binds to TRBC1 or TRBC2, and B or D comprises (a) an immune cell engager, e.g., an NK cell engager, e.g., an anti-NKp30, anti-NKp46, anti-NKG2D, or anti-CD16 antibody molecule, and (b) a cytokine inhibitor molecule;

(47) A comprises a first antigen binding domain that preferentially binds to TRBC1 or TRBC2, C comprises a second antigen binding domain that preferentially binds to TRBC1 or TRBC2, and B or D comprises (a) an immune cell engager, e.g., an NK cell engager, e.g., an anti-NKp30, anti-NKp46, anti-NKG2D, or anti-CD16 antibody molecule, and (b) a death receptor signal engager;

(48) A comprises a first antigen binding domain that preferentially binds to TRBC1 or TRBC2, C comprises a second antigen binding domain that preferentially binds to TRBC1 or TRBC2, and B or D comprises (a) an immune cell engager, e.g., an NK cell engager, e.g., an anti-NKp30, anti-NKp46, anti-NKG2D, or anti-CD16 antibody molecule, and (b) a stromal modifying moiety;

(49) A comprises a first antigen binding domain that preferentially binds to TRBC1 or TRBC2, C comprises a second antigen binding domain that preferentially binds to TRBC1 or TRBC2, and B or D comprises (a) an immune cell engager, e.g., a T cell engager, e.g., an anti-TCRβV antibody molecule, and (b) a cytokine molecule;

(50) A comprises a first antigen binding domain that preferentially binds to TRBC1 or TRBC2, C comprises a second antigen binding domain that preferentially binds to TRBC1 or TRBC2, and B or D comprises (a) an immune cell engager, e.g., a T cell engager, e.g., an anti-TCRβV antibody molecule, and (b) a cytokine inhibitor molecule;

(51) A comprises a first antigen binding domain that preferentially binds to TRBC1 or TRBC2, C comprises a second antigen binding domain that preferentially binds to TRBC1 or TRBC2, and B or D comprises (a) an immune cell engager, e.g., a T cell engager, e.g., an anti-TCRβV antibody molecule, and (b) a death receptor signal engager;

(52) A comprises a first antigen binding domain that preferentially binds to TRBC1 or TRBC2, C comprises a second antigen binding domain that preferentially binds to TRBC1 or TRBC2, and B or D comprises (a) an immune cell engager, e.g., a T cell engager, e.g., an anti-TCRβV antibody molecule, and (b) a stromal modifying moiety;

(53) A comprises a first antigen binding domain that preferentially binds to TRBC1 or TRBC2, C comprises a second antigen binding domain that preferentially binds to TRBC1 or TRBC2, and B or D comprises (a) a cytokine molecule and (b) a stromal modifying moiety;

(54) A comprises a first antigen binding domain that preferentially binds to TRBC1 or TRBC2, C comprises a second antigen binding domain that preferentially binds to TRBC1 or TRBC2, and B or D comprises (a) a cytokine molecule and (b) a death receptor signal engager;

(55) A comprises a first antigen binding domain that preferentially binds to TRBC1 or TRBC2, C comprises a second antigen binding domain that preferentially binds to TRBC1 or TRBC2, and B or D comprises (a) a cytokine inhibitor molecule and (b) a stromal modifying moiety;

(56) A comprises a first antigen binding domain that preferentially binds to TRBC1 or TRBC2, C comprises a second antigen binding domain that preferentially binds to TRBC1 or TRBC2, and B or D comprises (a) a cytokine inhibitor molecule and (b) a death receptor signal engager; or

(57) A comprises a first antigen binding domain that preferentially binds to TRBC1 or TRBC2, C comprises a second antigen binding domain that preferentially binds to TRBC1 or TRBC2, and B or D comprises (a) a stromal modifying moiety and (b) a death receptor signal engager.

123. The multifunctional molecule of embodiment 121 or 122, wherein the dimerization module comprises one or more immunoglobulin chain constant regions (e.g., Fc regions) comprising one or more of a paired cavity-protuberance ("knob-in-a hole"), an electrostatic interaction, or a strand-exchange.

124. The multifunctional molecule of embodiment 123, wherein the one or more immunoglobulin chain constant regions (e.g., Fc regions) comprise an amino acid substitution at a position chosen from one or more of 347, 349, 350, 351, 366, 368, 370, 392, 394, 395, 397, 398, 399, 405, 407, or 409, e.g., of the Fc region of human IgG1, optionally wherein the one or more immunoglobulin chain constant regions (e.g., Fc regions) comprise an amino acid substitution chosen from: T366S, L368A, or Y407V (e.g., corresponding to a cavity or hole), or T366W (e.g., corresponding to a protuberance or knob), or a combination thereof.

125. The multifunctional molecule of any one of embodiments 1-124, further comprising a linker, e.g., a linker between one or more of the antigen binding domain and the immune cell engager, the antigen binding domain and the cytokine molecule, the antigen binding domain and the stromal modifying moiety, the immune cell engager and the cytokine molecule, the immune cell engager and the stromal modifying moiety, the cytokine molecule and the stromal modifying moiety, the antigen binding domain and the dimerization module, the immune cell engager and the dimerization module, the cytokine molecule and the dimerization module, or the stromal modifying moiety and the dimerization module.

126. The multifunctional molecule of embodiment 125, wherein the linker is chosen from: a cleavable linker, a non-cleavable linker, a peptide linker, a flexible linker, a rigid linker, a helical linker, or a non-helical linker.

127. The multifunctional molecule of embodiment 125 or 126, wherein the linker is a peptide linker.

128. The multifunctional molecule of embodiment 127, wherein the peptide linker comprises Gly and Ser.

129. The multifunctional molecule of embodiment 128, wherein the peptide linker comprises an amino acid sequence chosen from SEQ ID NOs: 7249-7252 or 75-78.

130. A multifunctional molecule, comprising:

(i) a first antigen binding domain that preferentially binds to TRBC1, and (ii) an NK cell engager, e.g., an anti-NKp30 antibody molecule, anti-NKp46 antibody molecule, an anti-NKG2D antibody molecule, or an anti-CD16 antibody molecule.

131. The multifunctional molecule of embodiment 130, wherein the NK cell engager comprises an anti-NKp30 antibody molecule.

132. The multifunctional molecule of embodiment 130, wherein the NK cell engager comprises an anti-NKp46 antibody molecule.

133. The multifunctional molecule of embodiment 130, wherein the NK cell engager comprises an anti-NKG2D antibody molecule.

134. The multifunctional molecule of embodiment 130, wherein the NK cell engager comprises an anti-CD16 antibody molecule.

135. A multifunctional molecule, comprising:

(i) a first antigen binding domain that preferentially binds to TRBC1, and (ii) a death receptor signal engager.

136. A multifunctional molecule, comprising:

(i) a first antigen binding domain that preferentially binds to TRBC1, and (ii) a T cell engager, e.g., an antigen binding domain that binds to TCR beta V chain (TCRβV).

137. A multifunctional molecule, comprising:

(i) a first antigen binding domain that preferentially binds to TRBC1, and (ii) a cytokine inhibitor molecule, e.g., TGF-beta inhibitor.

138. The multifunctional molecule of any of embodiments 1 or 3-137, wherein the multifunctional molecule binds to TRBC1, TRBC2, or the tumor antigen monovalently.

139. The multifunctional molecule of any one of embodiments 1 or 3-137, wherein the multifunctional molecule binds to TRBC1, TRBC2, or the tumor antigen multivalently, e.g., di-, tri-, tetra-, penta-, hexa-, hepta-, octa-, nona-, or deca-valently.

140. The multifunctional molecule of any of embodiments 2-137, wherein the multifunctional molecule binds to TRBC1, TRBC2, or the lymphocyte expressing TRBC1 or TRBC2 monovalently.

141. The multifunctional molecule of any one of embodiments 2-137, wherein the multifunctional molecule binds to the lymphocyte expressing TRBC1 or TRBC2 multivalently, e.g., di-, tri-, tetra-, penta-, hexa-, hepta-, octa-, nona-, or deca-valently.

142. The multifunctional molecule of any preceding embodiment, wherein the multifunctional molecule binds, e.g., via the immune cell engager, to the immune cell monovalently.

143. The multifunctional molecule of any one of embodiments 1-141, wherein the multifunctional molecule binds, e.g., via the immune cell engager, to the immune cell multivalently, e.g., di-, tri-, tetra-, penta-, hexa-, hepta-, octa-, nona-, or deca-valently.

144. The multifunctional molecule of any preceding embodiment, further comprising a heavy chain constant region, e.g., an Fc region, that mediates antibody dependent cellular cytotoxicity (ADCC).

145. The multifunctional molecule of any preceding embodiment, further comprising a heavy chain constant region, e.g., an Fc region, that mediates antibody dependent cellular phagocytosis (ADCP).

146. The multifunctional molecule of embodiment 145, wherein the first antigen binding domain that binds TRBC1 or TRBC2 comprises an IgG2 heavy chain constant region or the immune cell engager, cytokine inhibitor molecule, or death receptor signal engager comprise an IgG2 heavy chain constant region.

147. The multifunctional molecule of any preceding embodiment, further comprising a heavy chain constant region, e.g., an Fc region, that mediates complement dependent cytotoxicity (e.g., via C1q).

148. An antibody molecule that binds TRBC1, comprising one or more CDRs, framework regions, variable domains, heavy or light chains, or an antigen binding domain chosen from Table 1, Table 2A or Table 2B, Table 4, Table 7, Table 8, Table 16, or a sequence substantially identical thereto.

149. The antibody molecule of embodiment 148, comprising a heavy chain variable region (VH) comprising a heavy chain framework region 1 (VHFWR1) amino acid sequence of SEQ ID NO: 215 (or a sequence with no more than 1, 2, 3, 4, 5, or 6 mutations, e.g., substitutions, additions, or deletions, therefrom), a VHFWR2 amino acid sequence of SEQ ID NO: 216 (or a sequence with no more than 1, 2, 3, 4, 5, or 6 mutations, e.g., substitutions, additions, or deletions, therefrom), a VHFWR3 amino acid sequence of SEQ ID NO: 217 (or a sequence with no more than 1, 2, 3, 4, 5, or 6 mutations, e.g., substitutions, additions, or deletions, therefrom), or a VHFWR4 amino acid sequence of SEQ ID NO: 218 (or a sequence with no more than 1, 2, 3, 4, 5, or 6 mutations, e.g., substitutions, additions, or deletions, therefrom).

150. The antibody molecule of either of embodiments 148 or 149, comprising a light chain variable region (VL) comprising a light chain framework region 1 (VLFWR1) amino acid sequence of SEQ ID NO: 238 (or a sequence with no more than 1, 2, 3, 4, 5, or 6 mutations, e.g., substitutions, additions, or deletions, therefrom), a VLFWR2 amino acid sequence of SEQ ID NO: 239 (or a sequence with no more than 1, 2, 3, 4, 5, or 6 mutations, e.g., substitutions, additions, or deletions, therefrom), a VLFWR3 amino acid sequence of SEQ ID NO: 240 (or a sequence with no more than 1, 2, 3, 4, 5, or 6 mutations, e.g., substitutions, additions, or deletions, therefrom), or a VLFWR4 amino acid sequence of SEQ ID NO: 241 (or a sequence with no more than 1, 2, 3, 4, 5, or 6 mutations, e.g., substitutions, additions, or deletions, therefrom).

151. The antibody molecule of any of embodiments 148-150, wherein the antibody molecule comprises a $V_H$ comprising the amino acid sequence of SEQ ID NO: 253 (or an amino acid sequence having at least about 75%, 80%, 85%, 90%, 95%, or 99% sequence identity thereto).

152. The antibody molecule of any of embodiments 148-151, wherein the antibody molecule comprises a VL comprising the amino acid sequence of SEQ ID NO: 258 (or an amino acid sequence having at least about 93%, 95%, or 99% sequence identity thereto).

153. A nucleic acid molecule encoding the multifunctional molecule or antibody molecule of any one of embodiments 1-152.

154. A vector, e.g., an expression vector, comprising the nucleic acid molecules of embodiment 153.

155. A host cell comprising the nucleic acid molecule of embodiment 153 or the vector of embodiment 154.

156. A method of making, e.g., producing, the multifunctional molecule or antibody molecule of any one of embodiments 1-152, comprising culturing the host cell of embodiment 155, under suitable conditions, e.g., conditions suitable for gene expression and/or homo- or heterodimerization.

157. A pharmaceutical composition comprising the multifunctional molecule of any one of embodiments 1-152 and a pharmaceutically acceptable carrier, excipient, or stabilizer.

158. A method of treating a cancer, or a premalignant condition comprising administering to a subject in need thereof the multifunctional molecule of any one of embodiments 1-152, wherein the multifunctional molecule is administered in an amount effective to treat the cancer.

159. The method of embodiment 158, further comprising identifying, evaluating, or selecting a subject in need of treatment, wherein identifying, evaluating, or selecting comprises determining (e.g., directly determining or indirectly determining, e.g., obtaining information regarding) whether a subject has cancer cells that express a T cell receptor comprising TRBC1 or TRBC2.

160. The method of embodiment 159, further comprising, responsive to determining that a subject has cancer cells that express a T cell receptor comprising TRBC1:

optionally, selecting the subject for treatment with a multifunctional molecule comprising an antigen binding domain that binds to a T cell receptor comprising TRBC1, and administering a multifunctional molecule comprising an antigen binding domain that binds to a T cell receptor comprising TRBC1.

161. The method of embodiment 160, further comprising not administering a multifunctional molecule comprising an antigen binding domain that binds to a T cell receptor comprising TRBC2.

162. A method of treating a cancer, e.g., a lymphoma or leukemia, comprising:

responsive to determining that a subject has cancer cells that express a T cell receptor comprising TRBC1, administering to a subject in need thereof the multifunctional molecule of any one of embodiments 1-152, wherein the multifunctional molecule is administered in an amount effective to treat the cancer.

163. The method of embodiment 162, further comprising, responsive to determining that a subject has cancer cells that express a T cell receptor comprising TRBC2:

optionally, selecting the subject for treatment with a multifunctional molecule comprising an antigen binding domain that binds to a T cell receptor comprising TRBC2, and administering a multifunctional molecule comprising an antigen binding domain that binds to a T cell receptor comprising TRBC2.

164. The method of embodiment 163, further comprising not administering a multifunctional molecule comprising an antigen binding domain that binds to a T cell receptor comprising TRBC1.

165. The method of any of embodiments 158-162, wherein the subject has cancer cells that express a T cell receptor comprising TRBC1.

166. The method of any of embodiments 158, 159, 163, or 164, wherein the subject has cancer cells that express a T cell receptor comprising TRBC2.

167. A method of identifying a subject in need of treatment for cancer using a multifunctional molecule or antibody molecule of any of embodiments 1-152, comprising determining (e.g., directly determining or indirectly determining, e.g., obtaining information regarding) whether a subject has cancer cells that express a T cell receptor comprising TRBC1 or TRBC2, wherein:

responsive to determining that the subject has cancer cells that express a T cell receptor comprising TRBC1, identifying the subject as a candidate for treatment using a multifunctional molecule comprising an antigen binding domain that binds to TRBC1, and optionally not as a candidate for treatment using a multifunctional molecule comprising an antigen binding domain that binds to TRBC2, and responsive to determining that the subject has cancer cells that express a T cell receptor comprising TRBC2, identifying the subject as a candidate for treatment using a multifunctional molecule comprising an antigen binding domain that binds to TRBC2, and optionally not as a candidate for treatment using a multifunctional molecule comprising an antigen binding domain that binds to TRBC1.

168. The method of embodiment 167, further comprising:

responsive to identifying the subject as a candidate for treatment using a multifunctional molecule comprising an antigen binding domain that binds to TRBC1, treating the subject with (e.g., administering to the subject) a multifunctional molecule comprising an antigen binding domain that binds to TRBC1, or responsive to identifying the subject as a candidate for treatment using a multifunctional molecule comprising an antigen binding domain that binds to TRBC2, treating the subject with (e.g., administering to the subject) a multifunctional molecule comprising an antigen binding domain that binds to TRBC2.

169. A method of evaluating a subject in need of treatment for cancer, e.g., a lymphoma, comprising determining (e.g., directly determining or indirectly determining, e.g., obtaining information regarding) whether a subject has cancer cells that express a T cell receptor comprising TRBC1 or TRBC2.

170. The method of embodiment 169, further comprising responsive to the evaluation, treating the subject with (e.g., administering to the subject) a multifunctional molecule comprising an antigen binding domain that binds to TRBC1 or a multifunctional molecule comprising an antigen binding domain that binds to TRBC2.

171. The method of any one of embodiments 158-170, wherein the cancer is a hematological cancer or a premalignant condition.

172. The method of embodiment 171, wherein the hematological cancer is leukemia or lymphoma.

173. The method of embodiment 172, wherein the hematological cancer is selected from leukemia (e.g., acute lymphoblastic leukemia (ALL), acute myeloid leukemia (AML), chronic lymphocytic leukemia (CLL), chronic myelogenous leukemia (CML), hairy cell leukemia, acute monocytic leukemia (AMoL), chronic myelomonocytic leukemia (CMML), juvenile myelomonocytic leukemia (JMML), or large granular lymphocytic leukemia), lymphoma (e.g., AIDS-related lymphoma, cutaneous T-cell lymphoma, Hodgkin lymphoma (e.g., classical Hodgkin lymphoma or nodular lymphocyte-predominant Hodgkin lymphoma), mycosis fungoides, non-Hodgkin lymphoma (e.g., B-cell non-Hodgkin lymphoma (e.g., Burkitt lymphoma, small lymphocytic lymphoma (CLL/SLL), diffuse large B-cell lymphoma, follicular lymphoma, immunoblastic large cell lymphoma, precursor B-lymphoblastic lymphoma, or mantle cell lymphoma) or T-cell non-Hodgkin lymphoma (mycosis fungoides, anaplastic large cell lymphoma, or precursor T-lymphoblastic lymphoma)), primary central nervous system lymphoma, Sézary syndrome, Waldenström macroglobulinemia), chronic myeloproliferative neoplasm, Langerhans cell histiocytosis, multiple myeloma/plasma cell neoplasm, myelodysplastic syndrome, or myelodysplastic/myeloproliferative neoplasm.

174. The method of embodiment 172, wherein the lymphoma is selected from Acquired immune deficiency syndrome (AIDS)-associated lymphoma, Angioimmunoblastic T-cell lymphoma, Adult T-cell leukemia/lymphoma, Burkitt lymphoma, Central nervous system (CNS) lymphoma, Diffuse large B-cell lymphoma (DLBCL), Lymphoblastic lymphoma, Mantle cell lymphoma (MCL), Peripheral T-cell lymphoma (PTCL) (e.g., Hepatosplenic T-cell lymphoma (HSGDTCL), Subcutaneous paniculitis-like T-cell lymphoma, or Enteropathy-associated T-cell lymphoma), Transformed follicular and transformed mucosa-associated lymphoid tissue (MALT) lymphomas, Cutaneous T-cell lymphoma (mycosis fungoides and Sézary syndrome), Follicular lymphoma, Lymphoplasmacytic lymphoma/Waldenström macroglobulinemia, Marginal zone B-cell lymphoma, Gastric mucosa-associated lymphoid tissue (MALT) lymphoma, Chronic lymphocytic leukemia/small-cell lymphocytic lymphoma (CLL/SLL), Extranodal T-/NK-cell lymphoma (nasal type), or Anaplastic large-cell lymphoma (e.g., primary cutaneous anaplastic large-cell lymphoma or systemic anaplastic large-cell lymphoma).

175. The method of any one of embodiments 158-170, the cancer is a solid tumor cancer.

176. The method of any of embodiments 158-175, further comprising administering a second therapeutic treatment.

177. The method of embodiment 176, wherein the second therapeutic treatment comprises a therapeutic agent (e.g., a chemotherapeutic agent, a biologic agent, hormonal therapy), radiation, or surgery.

178. The method of embodiment 177, wherein the therapeutic agent is selected from: a chemotherapeutic agent, or a biologic agent.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In the case of conflict, the present specification, including definitions, will control. In addition, the materials, methods, and examples are illustrative only and are not intended to be limiting.

Other features and advantages of the invention will be apparent from the following detailed description and claims.

EQUIVALENTS

Those skilled in the art will recognize, or be able to ascertain using no more than routine experimentation, many equivalents to the specific embodiments of the invention described herein. Such equivalents are intended to be encompassed by the following claims.

SEQUENCE LISTING (8706 sequences)

SEQ ID NO: 1 - protein, 119 aa, synthetic construct
  source 1..119: note = Description of Artificial Sequence: Synthetic polypeptide
QVQLQQSGPELVKPGTSVKISCKASGYSFTTYYIHWVKQRPGQGLEWIGWFFPGSGNIKYNEKFKGKATLTADTSSSTAYMQLSSLTSEESAVYFCAGSYYSYDVLDYWGHGTTLTVSS

SEQ ID NO: 2 - protein, 107 aa, synthetic construct
  source 1..107: note = Description of Artificial Sequence: Synthetic polypeptide
DILMTQSQKFMSTSLGDRVSVSCKASQNVGINVVWHQQKPGQSPKALIYSSSHRYSGVPDRFTGSGSGTDFTLTINNVQSEDLAEYFCQQFKSYPLTFGAGTKLELK

SEQ ID NO: 3 - protein, 10 aa, synthetic construct
  source 1..10: note = Description of Artificial Sequence: Synthetic peptide
GYSFTTYYIH

SEQ ID NO: 4 - protein, 17 aa, synthetic construct
  source 1..17: note = Description of Artificial Sequence: Synthetic peptide
WFFPGSGNIKYNEKFKG

SEQ ID NO: 5 - protein, 10 aa, synthetic construct
  source 1..10: note = Description of Artificial Sequence: Synthetic peptide
SYYSYDVLDY

SEQ ID NO: 6 - protein, 11 aa, synthetic construct
  source 1..11: note = Description of Artificial Sequence: Synthetic peptide
KASQNVGINVV

SEQ ID NO: 7 - protein, 7 aa, synthetic construct
  source 1..7: note = Description of Artificial Sequence: Synthetic peptide
SSSHRYS

SEQ ID NO: 8 - protein, 9 aa, synthetic construct
  source 1..9: note = Description of Artificial Sequence: Synthetic peptide
QQFKSYPLT

SEQ ID NO: 9 - protein, 119 aa, synthetic construct
  source 1..119: note = Description of Artificial Sequence: Synthetic polypeptide
QVQLVQSGAEVKKPGSSVKVSCKASGYSFTTYYIHWVRQAPGQGLEWMGWFFPGSGNIKYNEKFKGRVTITADTSTSTAYMELSSLRSEDTAVYYCAGSYYSYDVLDYWGQGTTVTVSS

SEQ ID NO: 10 - protein, 107 aa, synthetic construct
  source 1..107: note = Description of Artificial Sequence: Synthetic polypeptide
DIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIK

SEQ ID NO: 11 - protein, 107 aa, synthetic construct
  source 1..107: note = Description of Artificial Sequence: Synthetic polypeptide
DIQMTQSPSSLSASVGDRVTITCKASQNVGINVVWHQQKPGKVPKALIYSSSHRYSGVPSRFSGSGSGTDFTLTISSLQPEDVATYFCQQFKSYPLTFGQGTKLEIK

SEQ ID NO: 12 - DNA, 357 bp, synthetic construct
  source 1..357: mol_type = other DNA; note = Description of Artificial Sequence: Synthetic polynucleotide
caggtgcagctggttcagtctggcgccgaagtgaagaaacctggctcctccgtgaaggtgtcctgcaaggcttccggctactccttcaccacctactacatccactgggtccgacaggcccctggacaaggattggaatggatgggctggttcttccccggctccggcaacatcaagtacaacgagaagttcaagggccgcgtgaccatcaccgccgacacctctacctctaccgcctacatggaactgtccagcctgagatctgaggacaccgccgtgtactactgcgccggctcctactactcttacgacgtgctggattactggggccagggcaccacagtgacagtgtcctct

SEQ ID NO: 13 - DNA, 321 bp, synthetic construct
  source 1..321: mol_type = other DNA; note = Description of Artificial Sequence: Synthetic polynucleotide
gacatccagatgacccagtctccatccttcctgtccgcctctgtgggcgacagagtgaccatcacatgcaaggcctctcagaacgtgggcatcaacgtcgtgtggcaccagcagaagcctggcaaggctcctaaggctctgatctactcctccagccaccggtactctggcgtgccctctagattttccggctctggctctggcaccgagtttaccctgacaatctccagcctgcagcctgaggacttcgccacctacttttgccagcagttcaagagctaccctctgacctttggccagggcaccaagctggaaatcaag

SEQ ID NO: 14 - DNA, 321 bp, synthetic construct
  source 1..321: mol_type = other DNA; note = Description of Artificial Sequence: Synthetic polynucleotide
gacatccagatgacccagtctccatcctctctgtccgcctctgtgggcgacagagtgaccatcacatgcaaggcctctcagaacgtgggcatcaacgtcgtgtggcaccagcagaaacctggcaaggtgcccaaggctctgatctactcctccagccacagatactccggcgtgccctctagattctccggctctggctctggcaccgactttaccctgacaatctccagcctgcagcctgaggacgtggccacctacttttgccagcagttcaagagctaccctctgacctttggccagggcaccaagctggaaatcaag

SEQ ID NO: 15 - protein, 117 aa, synthetic construct
  source 1..117: note = Description of Artificial Sequence: Synthetic polypeptide
DVQLVESGGGLVQPGGSRKLSCAASGFTFSNFGMHWVRQAPDKGLEWVAYISSGSSTIYYADTLKGRFTISRDNPKNTLFLQMTSLRSEDTAMYYCARRGEGAMDYWGQGTSVTVSS

SEQ ID NO: 16 - protein, 106 aa, synthetic construct
  source 1..106: note = Description of Artificial Sequence: Synthetic polypeptide
ENVLTQSPAIMSASLGEKVTMSCRASSSVNYIYWYQQKSDASPKLWIYYTSNLAPGVPTRFSGSGSGNSYSLTISSMEGEDAATYYCQQFTSSPFTFGSGTKLEIK

SEQ ID NO: 17 - protein, 10 aa, synthetic construct
  source 1..10: note = Description of Artificial Sequence: Synthetic peptide
GFTFSNFGMH

SEQ ID NO: 18 - protein, 17 aa, synthetic construct
  source 1..17: note = Description of Artificial Sequence: Synthetic peptide
YISSGSSTIYYADTLKG

SEQ ID NO: 19 - protein, 8 aa, synthetic construct
  source 1..8: note = Description of Artificial Sequence: Synthetic peptide
RGEGAMDY

SEQ ID NO: 20 - protein, 10 aa, synthetic construct
  source 1..10: note = Description of Artificial Sequence: Synthetic peptide
RASSSVNYIY

SEQ ID NO: 21 - protein, 7 aa, synthetic construct
  source 1..7: note = Description of Artificial Sequence: Synthetic peptide
YTSNLAP

SEQ ID NO: 22 - protein, 9 aa, synthetic construct
  source 1..9: note = Description of Artificial Sequence: Synthetic peptide
QQFTSSPFT

SEQ ID NO: 23 - protein, 117 aa, synthetic construct
  source 1..117: note = Description of Artificial Sequence: Synthetic polypeptide
EVQLVESGGGLVQPGGSLRLSCAASGFTFSNFGMHWVRQAPGKGLEWVSYISSGSSTIYYADTLKGRFTISRDNAKNSLYLQMNSLRAEDTAVYYCARRGEGAMDYWGQGTTVTVSS

SEQ ID NO: 24 - protein, 117 aa, synthetic construct
  source 1..117: note = Description of Artificial Sequence: Synthetic polypeptide
EVQLVESGGGLVQPGGSLRLSCAASGFTFSNFGMHWVRQAPGKGLEWVSYISSGSSTIYYADTLKGRFTISRDNSKNTLYLQMNSLRAEDTAVYYCARRGEGAMDYWGQGTTVTVSS

SEQ ID NO: 25 - protein, 117 aa, synthetic construct
  source 1..117: note = Description of Artificial Sequence: Synthetic polypeptide
QVQLVESGGGVVQPGRSLRLSCAASGFTFSNFGMHWVRQAPGKGLEWVAYISSGSSTIYYADTLKGRFTISRDNSKNTLYLQMNSLRAEDTAVYYCARRGEGAMDYWGQGTTVTVSS

SEQ ID NO: 26 - protein, 106 aa, synthetic construct
  source 1..106: note = Description of Artificial Sequence: Synthetic polypeptide
DNQLTQSPSFLSASVGDRVTITCRASSSVNYIYWYQQKPGKAPKLLIYYTSNLAPGVPSRFSGSGSGNEYTLTISSLQPEDFATYYCQQFTSSPFTFGQGTKLEIK

SEQ ID NO: 27 - protein, 106 aa, synthetic construct
  source 1..106: note = Description of Artificial Sequence: Synthetic polypeptide
DNQLTQSPSSLSASVGDRVTITCRASSSVNYIYWYQQKPGKAPKLLIYYTSNLAPGVPSRFSGSGSGNDYTLTISSLQPEDFATYYCQQFTSSPFTFGQGTKLEIK

SEQ ID NO: 28 - protein, 106 aa, synthetic construct
  source 1..106: note = Description of Artificial Sequence: Synthetic polypeptide
ENVLTQSPATLSVSPGERATLSCRASSSVNYIYWYQQKPGQAPRLLIYYTSNLAPGIPARFSGSGSGNEYTLTISSLQSEDFAVYYCQQFTSSPFTFGQGTKLEIK

SEQ ID NO: 29 - protein, 105 aa, synthetic construct
  source 1..105: note = Description of Artificial Sequence: Synthetic polypeptide
QNVLTQPPSASGTPGQRVTISCRASSSVNYIYWYQQLPGTAPKLLIYYTSNLAPGVPDRFSGSGSGNSYSLAISGLRSEDEADYYCQQFTSSPFTFGTGTKVTVL

SEQ ID NO: 30 - protein, 105 aa, synthetic construct
  source 1..105: note = Description of Artificial Sequence: Synthetic polypeptide
SNELTQPPSVSVSPGQTARITCRASSSVNYIYWYQQKSGQAPVLVIYYTSNLAPGIPERFSGSGSGNMYTLTISGAQVEDEADYYCQQFTSSPFTFGTGTKVTVL

SEQ ID NO: 31 - DNA, 351 bp, synthetic construct
  source 1..351: mol_type = other DNA; note = Description of Artificial Sequence: Synthetic polynucleotide
gaggtgcagctggttgaatctggcggaggattggttcagcctggcggctctctgagactgtcttgtgccgcttctggcttcaccttctccaacttcggcatgcactgggtccgacaggcccctggaaaaggactggaatgggtgtcctacatctcctccggctcctccaccatctactacgctgacaccctgaagggcagattcaccatctctcgggacaacgccaagaactccctgtacctgcagatgaacagcctgagagccgaggacaccgccgtgtactactgtgctagaagaggcgagggcgccatggattattggggccagggaaccacagtgaccgtgtctagc

SEQ ID NO: 32 - DNA, 351 bp, synthetic construct
  source 1..351: mol_type = other DNA; note = Description of Artificial Sequence: Synthetic polynucleotide
gaggtgcagctggttgaatctggcggaggattggttcagcctggcggctctctgagactgtcttgtgccgcttctggcttcaccttctccaacttcggcatgcactgggtccgacaggcccctggaaaaggactggaatgggtgtcctacatctcctccggctcctccaccatctactacgctgacaccctgaagggcagattcaccatcagccgggacaactccaagaacaccctgtacctgcagatgaactccctgagagccgaggacaccgccgtgtactactgtgctagaagaggcgagggcgccatggattattggggccagggaaccacagtgaccgtgtctagc

SEQ ID NO: 33 - DNA, 351 bp, synthetic construct
  source 1..351: mol_type = other DNA; note = Description of Artificial Sequence: Synthetic polynucleotide
caggtgcagctggtggaatctggtggcggagttgtgcagcctggcagatccctgagactgtcttgtgccgcctctggcttcaccttctccaacttcggcatgcactgggtccgacaggcccctggaaaaggattggagtgggtcgcctacatctcctccggctcctccaccatctactacgctgacaccctgaagggcagattcaccatcagccgggacaactccaagaacaccctgtacctgcagatgaactccctgagagccgaggacaccgccgtgtactactgtgctagaagaggcgagggcgccatggattattggggccagggaaccacagtgaccgtgtctagc

SEQ ID NO: 34 - DNA, 318 bp, synthetic construct
  source 1..318: mol_type = other DNA; note = Description of Artificial Sequence: Synthetic polynucleotide
gataaccagctgacccagtctcctagcttcctgtctgcctctgtgggcgacagagtgacaattacctgccgggcctcctcctccgtgaactacatctactggtatcagcagaagcccggcaaggcccctaagctgctgatctactacacctccaatctggcccctggcgtgccctctagattttccggatctggctccggcaacgagtataccctgacaatctccagcctgcagcctgaggacttcgccacctactactgccagcagttcacctcctctccattcacctttggccagggcaccaagctggaaatcaaa

SEQ ID NO: 35 - DNA, 317 bp, synthetic construct
  source 1..317: mol_type = other DNA; note = Description of Artificial Sequence: Synthetic polynucleotide
ataaccagctgacccagtctccttccagcctgtctgcttctgtgggcgacagagtgacaattacctgccgggcctcctcctccgtgaactacatctactggtatcagcagaagcccggcaaggcccctaagctgctgatctactacacctccaatctggcccctggcgtgccctctagattttccggatctggctccggcaacgactataccctgacaatctccagcctgcagcctgaggacttcgccacctactactgccagcagttcacctcctctccattcacctttggccagggcaccaagctggaaatcaaa

SEQ ID NO: 36 - DNA, 318 bp, synthetic construct
  source 1..318: mol_type = other DNA; note = Description of Artificial Sequence: Synthetic polynucleotide
gagaatgtgctgacccagtctcctgccacactgtctgttagccctggcgagagagctaccctgagctgcagagcctcttcctccgtgaactacatctactggtatcagcagaagcccggccaggctcctagactgctgatctactacacctccaatctggcccctggcatccctgccagattttccggatctggctccggcaacgagtataccctgaccatctccagcctgcagtccgaggactttgctgtgtactattgccagcagttcacaagcagccctttcacctttggccagggcaccaagctggaaatcaaa

SEQ ID NO: 37 - DNA, 315 bp, synthetic construct
  source 1..315: mol_type = other DNA; note = Description of Artificial Sequence: Synthetic polynucleotide
cagaatgtgctgacccaacctccttccgcctctggcacacctggacagagagtgacaatctcctgccgggcctcctcctccgtgaactacatctactggtatcagcagctgcccggcaccgctcctaaactgctgatctactacacctccaatctggcccctggcgtgcccgatagattttccggatctggctccggcaactcctacagcctggctatctctggcctgagatctgaggacgaggccgactactactgccagcagttcacctcctctccattcacctttggcaccggcaccaaagtgacagttctt

SEQ ID NO: 38 - DNA, 315 bp, synthetic construct
  source 1..315: mol_type = other DNA; note = Description of Artificial Sequence: Synthetic polynucleotide
tctaatgagctgacccagcctccttccgtgtccgtgtctcctggacagaccgccagaattacctgccgggcctcctcctccgtgaactacatctactggtatcagcagaagtccggccaggctcctgtgctcgtgatctactacacctccaatctggcccctggcatccctgagagattctccggatctggctccggcaacatgtacaccctgaccatctctggcgcccaggtggaagatgaggccgactactactgccagcagttcacctcctctccattcacctttggcaccggcaccaaagtgacagttctt

SEQ ID NO: 39 - protein, 107 aa, Homo sapiens [sequence omitted]

SEQ ID NO: 40 - protein, 326 aa, synthetic construct
  source 1..326: note = Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 41 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 330 aa, synthetic construct
  source 1..330: note = Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43 - DNA, 344 bp, synthetic construct
  source 1..344: mol_type = other DNA; note = Description of Artificial Sequence: Synthetic polynucleotide
atgagcatcggcctcctgtgctgtgcagccttgtctctcctgtgggcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagttactc

SEQ ID NO: 44 - protein, 114 aa, synthetic construct
  source 1..114: note = Description of Artificial Sequence: Synthetic polypeptide
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSY

SEQ ID NO: 45 - protein, 5 aa, synthetic construct
  source 1..5: note = Description of Artificial Sequence: Synthetic peptide
TYYIH

SEQ ID NO: 46 - protein, 17 aa, synthetic construct
  source 1..17: note = Description of Artificial Sequence: Synthetic peptide
WFFPGSGNIKYNEKFKG

SEQ ID NO: 47 - protein, 10 aa, synthetic construct
  source 1..10: note = Description of Artificial Sequence: Synthetic peptide
SYYSYDVLDY

SEQ ID NO: 48 - protein, 7 aa, synthetic construct
  source 1..7: note = Description of Artificial Sequence: Synthetic peptide
GYSFTTY

SEQ ID NO: 49 - protein, 6 aa, synthetic construct
  source 1..6: note = Description of Artificial Sequence: Synthetic peptide
FPGSGN

SEQ ID NO: 50 - protein, 10 aa, synthetic construct
  source 1..10: note = Description of Artificial Sequence: Synthetic peptide
SYYSYDVLDY

SEQ ID NO: 51 - protein, 11 aa, synthetic construct
  source 1..11: note = Description of Artificial Sequence: Synthetic peptide
KASQNVGINVV

SEQ ID NO: 52 - protein, 7 aa, synthetic construct
  source 1..7: note = Description of Artificial Sequence: Synthetic peptide
SSSHRYS

SEQ ID NO: 53 - protein, 9 aa, synthetic construct
  source 1..9: note = Description of Artificial Sequence: Synthetic peptide
QQFKSYPLT

SEQ ID NO: 54 - protein, 11 aa, synthetic construct
  source 1..11: note = Description of Artificial Sequence: Synthetic peptide
KASQNVGINVV

SEQ ID NO: 55 - protein, 7 aa, synthetic construct
  source 1..7: note = Description of Artificial Sequence: Synthetic peptide
SSSHRYS

SEQ ID NO: 56 - protein, 9 aa, synthetic construct
  source 1..9: note = Description of Artificial Sequence: Synthetic peptide
QQFKSYPLT

SEQ ID NO: 57 - protein, 5 aa, synthetic construct
  source 1..5: note = Description of Artificial Sequence: Synthetic peptide
NFGMH

SEQ ID NO: 58 - protein, 17 aa, synthetic construct
  source 1..17: note = Description of Artificial Sequence: Synthetic peptide
YISSGSSTIYYADTLKG

SEQ ID NO: 59 - protein, 8 aa, synthetic construct
  source 1..8: note = Description of Artificial Sequence: Synthetic peptide
RGEGAMDY

SEQ ID NO: 60 - protein, 7 aa, synthetic construct
  source 1..7: note = Description of Artificial Sequence: Synthetic peptide
GFTFSNF

SEQ ID NO: 61 - protein, 6 aa, synthetic construct
  source 1..6: note = Description of Artificial Sequence: Synthetic peptide
SSGSST

SEQ ID NO: 62 - protein, 8 aa, synthetic construct
  source 1..8: note = Description of Artificial Sequence: Synthetic peptide
RGEGAMDY

SEQ ID NO: 63 - protein, 10 aa, synthetic construct
  source 1..10: note = Description of Artificial Sequence: Synthetic peptide
RASSSVNYIY

SEQ ID NO: 64 - protein, 7 aa, synthetic construct
  source 1..7: note = Description of Artificial Sequence: Synthetic peptide
YTSNLAP

SEQ ID NO: 65 - protein, 9 aa, synthetic construct
  source 1..9: note = Description of Artificial Sequence: Synthetic peptide
QQFTSSPFT

SEQ ID NO: 66 - protein, 10 aa, synthetic construct
  source 1..10: note = Description of Artificial Sequence: Synthetic peptide
RASSSVNYIY

SEQ ID NO: 67 - protein, 7 aa, synthetic construct
  source 1..7: note = Description of Artificial Sequence: Synthetic peptide
YTSNLAP

SEQ ID NO: 68 - protein, 9 aa, synthetic construct
  source 1..9: note = Description of Artificial Sequence: Synthetic peptide
QQFTSSPFT

SEQ ID NO: 69-74 - skipped (6 entries)

SEQ ID NO: 75 - protein, 14 aa, synthetic construct
  source 1..14: note = Description of Artificial Sequence: Synthetic peptide
AEAAAKEAAAKAAA

SEQ ID NO: 76 - protein, 19 aa, synthetic construct
  source 1..19: note = Description of Artificial Sequence: Synthetic peptide
AEAAAKEAAAKEAAAKAAA

SEQ ID NO: 77 - protein, 24 aa, synthetic construct
  source 1..24: note = Description of Artificial Sequence: Synthetic peptide
AEAAAKEAAAKEAAAKEAAAKAAA

SEQ ID NO: 78 - protein, 29 aa, synthetic construct
  source 1..29: note = Description of Artificial Sequence: Synthetic peptide
AEAAAKEAAAKEAAAKEAAAKEAAAKAAA

SEQ ID NO: 79-91 - skipped (13 entries)

SEQ ID NO: 92 - protein, 390 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 93 - protein, 414 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 94 - protein, 412 aa, Homo sapiens
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 95 - protein, 503 aa, Homo sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 96 - protein, 507 aa, Homo sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTGPFSVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 97 - protein, 426 aa, Homo sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 98 - protein, 567 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 99 - protein, 592 aa, Homo sapiens
MGRGLLRGLWPLHIVLWTRIASTIPPHVQKSDVEMEAQKDEIICPSCNRTAHPLRHINNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 100 - protein, 137 aa, Homo sapiens
TIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPD

SEQ ID NO: 101 - protein, 136 aa, Homo sapiens
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPD

SEQ ID NO: 102 - protein, 162 aa, Homo sapiens
TIPPHVQKSDVEMEAQKDEIICPSCNRTAHPLRHINNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPD

SEQ ID NO: 103 - protein, 101 aa, Homo sapiens
QLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIF

SEQ ID NO: 104 - protein, 93 aa, Homo sapiens
LQCFCHLCTKDNFTCVTDGLCFVSVTETTDKVIHNSMCIAEIDLIPRDRPFVCAPSSKTGSVTTTYCCNQDHCNKIELPTTVKSSPGLGPVEL

SEQ ID NO: 105 - protein, 79 aa, Homo sapiens
ALQCFCHLCTKDNFTCVTDGLCFVSVTETTDKVIHNSMCIAEIDLIPRDRPFVCAPSSKTGSVTTTYCCNQDHCNKIEL

SEQ ID NO: 106 - protein, 851 aa, Homo sapiens
MTSHYVIAIFALMSSCLATAGPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 107 - protein, 850 aa, Homo sapiens
MTSHYVIAIFALMSSCLATAGPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 108 - protein, 767 aa, Homo sapiens
GPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTV

SEQ ID NO: 109-116 - skipped (8 entries)

SEQ ID NO: 117 - protein, 361 aa, Homo sapiens
LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 118 - protein, 394 aa, Homo sapiens
LSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 119 - protein, 389 aa, Homo sapiens
LSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 120 - protein, 470 aa, Homo sapiens
LQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 121 - protein, 474 aa, Homo sapiens
LQCFCHLCTKDNFTCVTDGLCFVSVTETTDKVIHNSMCIAEIDLIPRDRPFVCAPSSKTGSVTTTYCCNQDHCNKIELPTTGPFSVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 122 - protein, 393 aa, Homo sapiens
LQCFCHLCTKDNFTCVTDGLCFVSVTETTDKVIHNSMCIAEIDLIPRDRPFVCAPSSKTGSVTTTYCCNQDHCNKIELPTTGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 123 - protein, 545 aa, Homo sapiens
TIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 124 - protein, 570 aa, Homo sapiens
TIPPHVQKSDVEMEAQKDEIICPSCNRTAHPLRHINNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 125 - protein, 831 aa, Homo sapiens
GPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 126 - protein, 830 aa, Homo sapiens
GPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 127-191 - skipped (65 entries)

SEQ ID NO: 192 - protein, 481 aa, synthetic construct
  source 1..481: note = Description of Artificial Sequence: Synthetic polypeptide
  VARIANT 330: note = MOD_RES - Lys or absent
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGXGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPD

SEQ ID NO: 193 - protein, 481 aa, synthetic construct
  source 1..481: note = Description of Artificial Sequence: Synthetic polypeptide
  VARIANT 330: note = MOD_RES - Lys or absent
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGXGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPD

SEQ ID NO: 194 - protein, 378 aa, synthetic construct
  source 1..378: note = Description of Artificial Sequence: Synthetic polypeptide
  VARIANT 227: note = MOD_RES - Lys or absent
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGXGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPD

SEQ ID NO: 195 - protein, 378 aa, synthetic construct
  source 1..378: note = Description of Artificial Sequence: Synthetic polypeptide
  VARIANT 227: note = MOD_RES - Lys or absent
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGXGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPD

SEQ ID NO: 196 - protein, 481 aa, synthetic construct
  source 1..481: note = Description of Artificial Sequence: Synthetic polypeptide
  VARIANT 481: note = MOD_RES - Lys or absent
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGX

SEQ ID NO: 197 - protein, 481 aa, synthetic construct
  source 1..481: note = Description of Artificial Sequence: Synthetic polypeptide
  VARIANT 481: note = MOD_RES - Lys or absent
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGX

SEQ ID NO: 198 - protein, 257 aa, synthetic construct
  source 1..257: note = Description of Artificial Sequence: Synthetic polypeptide
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 199 - protein, 258 aa, synthetic construct
  source 1..258: note = Description of Artificial Sequence: Synthetic polypeptide
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 200 - protein, 5 aa, synthetic construct
  source 1..5: note = Description of Artificial Sequence: Synthetic peptide
GYVMH

SEQ ID NO: 201 - protein, 17 aa, synthetic construct
  source 1..17: note = Description of Artificial Sequence: Synthetic peptide
FINPYNDDIQSNERFRG

SEQ ID NO: 202 - protein, 15 aa, synthetic construct
  source 1..15: note = Description of Artificial Sequence: Synthetic peptide
GAGYNFDGAYRFFDF

SEQ ID NO: 203 - protein, 30 aa, synthetic construct
  source 1..30: note = Description of Artificial Sequence: Synthetic polypeptide
EVRLQQSGPDLIKPGASVKMSCKASGYTFT

SEQ ID NO: 204 - protein, 14 aa, synthetic construct
  source 1..14: note = Description of Artificial Sequence: Synthetic peptide
WVKQRPGQGLEWIG

SEQ ID NO: 205 - protein, 32 aa, synthetic construct
  source 1..32: note = Description of Artificial Sequence: Synthetic polypeptide
KATLTSDKSSTTAYMELSSLTSEDSAVYYCAR

SEQ ID NO: 206 - protein, 11 aa, synthetic construct
  source 1..11: note = Description of Artificial Sequence: Synthetic peptide
WGQGTTLTVSS

SEQ ID NO: 207 - protein, 30 aa, synthetic construct
  source 1..30: note = Description of Artificial Sequence: Synthetic polypeptide
QVQLVQSGAEVKKPGASVKVSCKASGYTFT

SEQ ID NO: 208 - protein, 14 aa, synthetic construct
  source 1..14: note = Description of Artificial Sequence: Synthetic peptide
WVRQAPGQGLEWMG

SEQ ID NO: 209 - protein, 32 aa, synthetic construct
  source 1..32: note = Description of Artificial Sequence: Synthetic polypeptide
RVTMTSDKSTTTAYMELSSLRSEDTAVYYCAR

SEQ ID NO: 210 - protein, 11 aa, synthetic construct
  source 1..11: note = Description of Artificial Sequence: Synthetic peptide
WGQGTLVTVSS

SEQ ID NO: 211 - protein, 30 aa, synthetic construct; identical to SEQ ID NO: 207
  source 1..30: note = Description of Artificial Sequence: Synthetic polypeptide

SEQ ID NO: 212 - protein, 14 aa, synthetic construct
  source 1..14: note = Description of Artificial Sequence: Synthetic peptide
WVRQAPGQGLEWMG

SEQ ID NO: 213 - protein, 32 aa, synthetic construct
  source 1..32: note = Description of Artificial Sequence: Synthetic polypeptide
WVTMTSDKSITTAYMELSRLRSDDTAVYYCAR

SEQ ID NO: 214 - protein, 11 aa, synthetic construct
  source 1..11: note = Description of Artificial Sequence: Synthetic peptide
WGQGTLVTVSS

SEQ ID NO: 215 - protein, 30 aa, synthetic construct
  source 1..30: note = Description of Artificial Sequence: Synthetic polypeptide
QVQLVQSGAEVKKPGSSVKVSCKASGYTFT

SEQ ID NO: 216 - protein, 14 aa, synthetic construct
  source 1..14: note = Description of Artificial Sequence: Synthetic peptide
WVRQAPGQGLEWMG

SEQ ID NO: 217 - protein, 32 aa, synthetic construct
  source 1..32: note = Description of Artificial Sequence: Synthetic polypeptide
RVTITSDKSTTTAYMELSSLRSEDTAVYYCAR

SEQ ID NO: 218 - protein, 11 aa, synthetic construct
  source 1..11: note = Description of Artificial Sequence: Synthetic peptide
WGQGTLVTVSS

SEQ ID NO: 219 - protein, 30 aa, synthetic construct; identical to SEQ ID NO: 207
  source 1..30: note = Description of Artificial Sequence: Synthetic polypeptide

SEQ ID NO: 220 - protein, 14 aa, synthetic construct
  source 1..14: note = Description of Artificial Sequence: Synthetic peptide
WVRQAPGQRLEWMG

SEQ ID NO: 221 - protein, 32 aa, synthetic construct
  source 1..32: note = Description of Artificial Sequence: Synthetic polypeptide
RVTITSDKSATTAYMELSSLRSEDTAVYYCAR

SEQ ID NO: 222 - protein, 11 aa, synthetic construct
  source 1..11: note = Description of Artificial Sequence: Synthetic peptide
WGQGTLVTVSS

SEQ ID NO: 223 - protein, 16 aa, synthetic construct
  source 1..16: note = Description of Artificial Sequence: Synthetic peptide
RSSQRLVHSNGNTYLH

SEQ ID NO: 224 - protein, 7 aa, synthetic construct
  source 1..7: note = Description of Artificial Sequence: Synthetic peptide
RVSNRFP

SEQ ID NO: 225 - protein, 9 aa, synthetic construct
  source 1..9: note = Description of Artificial Sequence: Synthetic peptide
SQSTHVPYT

SEQ ID NO: 226 - protein, 23 aa, synthetic construct
  source 1..23: note = Description of Artificial Sequence: Synthetic peptide
DVVMTQSPLSLPVSLGDQASISC

SEQ ID NO: 227 - protein, 15 aa, synthetic construct
  source 1..15: note = Description of Artificial Sequence: Synthetic peptide
WYLQKPGQSPKLLIY

SEQ ID NO: 228 - protein, 32 aa, synthetic construct
  source 1..32: note = Description of Artificial Sequence: Synthetic polypeptide
GVPDRFSGSGSGTDFTLKISRVEAEDLGIYFC

SEQ ID NO: 229 - protein, 10 aa, synthetic construct
  source 1..10: note = Description of Artificial Sequence: Synthetic peptide
FGGGTKLEIK

SEQ ID NO: 230 - protein, 23 aa, synthetic construct
  source 1..23: note = Description of Artificial Sequence: Synthetic peptide
DVVMTQSPLSLPVTPGEPASISC

SEQ ID NO: 231 - protein, 15 aa, synthetic construct
  source 1..15: note = Description of Artificial Sequence: Synthetic peptide
WYLQKPGQSPQLLIY

SEQ ID NO: 232 - protein, 32 aa, synthetic construct
  source 1..32: note = Description of Artificial Sequence: Synthetic polypeptide
GVPDRFSGSGSGTDFTLKISRVEAEDVGVYFC

SEQ ID NO: 233 - protein, 10 aa, synthetic construct
  source 1..10: note = Description of Artificial Sequence: Synthetic peptide
FGGGTKVEIK

SEQ ID NO: 234 - protein, 23 aa, synthetic construct
  source 1..23: note = Description of Artificial Sequence: Synthetic peptide
EVVMTQSPGTLSLSPGERATLSC

SEQ ID NO: 235 - protein, 15 aa, synthetic construct
  source 1..15: note = Description of Artificial Sequence: Synthetic peptide
WYQQKPGQAPRLLIY

SEQ ID NO: 236 - protein, 32 aa, synthetic construct
  source 1..32: note = Description of Artificial Sequence: Synthetic polypeptide
GIPDRFSGSGSGTDFTLTISRLEPEDFAVYFC

SEQ ID NO: 237 - protein, 10 aa, synthetic construct
  source 1..10: note = Description of Artificial Sequence: Synthetic peptide
FGGGTKVEIK

SEQ ID NO: 238 - protein, 23 aa, synthetic construct
  source 1..23: note = Description of Artificial Sequence: Synthetic peptide
DVVMTQSPLSLPVTLGQPASISC

SEQ ID NO: 239 - protein, 15 aa, synthetic construct
  source 1..15: note = Description of Artificial Sequence: Synthetic peptide
WYQQRPGQSPRLLIY

SEQ ID NO: 240 - protein, 32 aa, synthetic construct; identical to SEQ ID NO: 232
  source 1..32: note = Description of Artificial Sequence: Synthetic polypeptide

SEQ ID NO: 241 - protein, 10 aa, synthetic construct
  source 1..10: note = Description of Artificial Sequence: Synthetic peptide
FGGGTKVEIK

SEQ ID NO: 242 - protein, 23 aa, synthetic construct
  source 1..23: note = Description of Artificial Sequence: Synthetic peptide
DVVMTQTPLSLPVTPGEPASISC

SEQ ID NO: 243 - protein, 15 aa, synthetic construct
  source 1..15: note = Description of Artificial Sequence: Synthetic peptide
WYLQKPGQSPQLLIY

SEQ ID NO: 244 - protein, 32 aa, synthetic construct; identical to SEQ ID NO: 232
  source 1..32: note = Description of Artificial Sequence: Synthetic polypeptide

SEQ ID NO: 245 - protein, 10 aa, synthetic construct
  source 1..10: note = Description of Artificial Sequence: Synthetic peptide
FGGGTKVEIK

SEQ ID NO: 246 - protein, 23 aa, synthetic construct
  source 1..23: note = Description of Artificial Sequence: Synthetic peptide
DVVMTQTPLSLSVTPGQPASISC

SEQ ID NO: 247 - protein, 15 aa, synthetic construct
  source 1..15: note = Description of Artificial Sequence: Synthetic peptide
WYLQKPGQSPQLLIY

SEQ ID NO: 248 - protein, 32 aa, synthetic construct; identical to SEQ ID NO: 232
  source 1..32: note = Description of Artificial Sequence: Synthetic polypeptide

SEQ ID NO: 249 - protein, 10 aa, synthetic construct
  source 1..10: note = Description of Artificial Sequence: Synthetic peptide
FGGGTKVEIK

SEQ ID NO: 250 - protein, 124 aa, synthetic construct
  source 1..124: note = Description of Artificial Sequence: Synthetic polypeptide
EVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSS

SEQ ID NO: 251 - protein, 124 aa, synthetic construct
  source 1..124: note = Description of Artificial Sequence: Synthetic polypeptide
QVQLVQSGAEVKKPGASVKVSCKASGYTFTGYVMHWVRQAPGQGLEWMGFINPYNDDIQSNERFRGRVTMTSDKSTTTAYMELSSLRSEDTAVYYCARGAGYNFDGAYRFFDFWGQGTLVTVSS

SEQ ID NO: 252 - protein, 124 aa, synthetic construct
  source 1..124: note = Description of Artificial Sequence: Synthetic polypeptide
QVQLVQSGAEVKKPGASVKVSCKASGYTFTGYVMHWVRQAPGQGLEWMGFINPYNDDIQSNERFRGWVTMTSDKSITTAYMELSRLRSDDTAVYYCARGAGYNFDGAYRFFDFWGQGTLVTVSS

SEQ ID NO: 253 - protein, 124 aa, synthetic construct
  source 1..124: note = Description of Artificial Sequence: Synthetic polypeptide
QVQLVQSGAEVKKPGSSVKVSCKASGYTFTGYVMHWVRQAPGQGLEWMGFINPYNDDIQSNERFRGRVTITSDKSTTTAYMELSSLRSEDTAVYYCARGAGYNFDGAYRFFDFWGQGTLVTVSS

SEQ ID NO: 254 - protein, 124 aa, synthetic construct
  source 1..124: note = Description of Artificial Sequence: Synthetic polypeptide
QVQLVQSGAEVKKPGASVKVSCKASGYTFTGYVMHWVRQAPGQRLEWMGFINPYNDDIQSNERFRGRVTITSDKSATTAYMELSSLRSEDTAVYYCARGAGYNFDGAYRFFDFWGQGTLVTVSS

SEQ ID NO: 255 - protein, 112 aa, synthetic construct
  source 1..112: note = Description of Artificial Sequence: Synthetic polypeptide
DVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIK

SEQ ID NO: 256 - protein, 112 aa, synthetic construct
  source 1..112: note = Description of Artificial Sequence: Synthetic polypeptide
DVVMTQSPLSLPVTPGEPASISCRSSQRLVHSNGNTYLHWYLQKPGQSPQLLIYRVSNRFPGVPDRFSGSGSGTDFTLKISRVEAEDVGVYFCSQSTHVPYTFGGGTKVEIK

SEQ ID NO: 257 - protein, 112 aa, synthetic construct
  source 1..112: note = Description of Artificial Sequence: Synthetic polypeptide
EVVMTQSPGTLSLSPGERATLSCRSSQRLVHSNGNTYLHWYQQKPGQAPRLLIYRVSNRFPGIPDRFSGSGSGTDFTLTISRLEPEDFAVYFCSQSTHVPYTFGGGTKVEIK

SEQ ID NO: 258 - protein, 112 aa, synthetic construct
  source 1..112: note = Description of Artificial Sequence: Synthetic polypeptide
DVVMTQSPLSLPVTLGQPASISCRSSQRLVHSNGNTYLHWYQQRPGQSPRLLIYRVSNRFPGVPDRFSGSGSGTDFTLKISRVEAEDVGVYFCSQSTHVPYTFGGGTKVEIK

SEQ ID NO: 259 - protein, 112 aa, synthetic construct
  source 1..112: note = Description of Artificial Sequence: Synthetic polypeptide
DVVMTQTPLSLPVTPGEPASISCRSSQRLVHSNGNTYLHWYLQKPGQSPQLLIYRVSNRFPGVPDRFSGSGSGTDFTLKISRVEAEDVGVYFCSQSTHVPYTFGGGTKVEIK

SEQ ID NO: 260 - protein, 112 aa, synthetic construct
  source 1..112: note = Description of Artificial Sequence: Synthetic polypeptide
DVVMTQTPLSLSVTPGQPASISCRSSQRLVHSNGNTYLHWYLQKPGQSPQLLIYRVSNRFPGVPDRFSGSGSGTDFTLKISRVEAEDVGVYFCSQSTHVPYTFGGGTKVEIK

SEQ ID NO: 261-5999 - skipped (5739 entries)

SEQ ID NO: 6000 - protein, 5 aa, synthetic construct
  source 1..5: note = Description of Artificial Sequence: Synthetic peptide
GYHWN

SEQ ID NO: 6001 - protein, 16 aa, synthetic construct
  source 1..16: note = Description of Artificial Sequence: Synthetic peptide
YIYSSGSTSYNPSLKS

SEQ ID NO: 6002 - protein, 8 aa, synthetic construct
  source 1..8: note = Description of Artificial Sequence: Synthetic peptide
GNWHYFDF

SEQ ID NO: 6003 - protein, 32 aa, synthetic construct
  source 1..32: note = Description of Artificial Sequence: Synthetic polypeptide
QIQLQESGPGLVKPSQSLSLTCSVTGFSINTG

SEQ ID NO: 6004 - protein, 14 aa, synthetic construct
  source 1..14: note = Description of Artificial Sequence: Synthetic peptide
WIRQFPGKKLEWMG

SEQ ID NO: 6005 - protein, 32 aa, synthetic construct
  source 1..32: note = Description of Artificial Sequence: Synthetic polypeptide
RISITRDTSKNQFFLQLNSVTTEDTATYYCAR

SEQ ID NO: 6006 - protein, 11 aa, synthetic construct
  source 1..11: note = Description of Artificial Sequence: Synthetic peptide
WGQGTMVTVSS

SEQ ID NO: 6007 - protein, 5 aa, synthetic construct
  source 1..5: note = Description of Artificial Sequence: Synthetic peptide
GYHWN

SEQ ID NO: 6008 - protein, 16 aa, synthetic construct
  source 1..16: note = Description of Artificial Sequence: Synthetic peptide
YIYSSGTTRYNPSLKS

SEQ ID NO: 6009 - protein, 8 aa, synthetic construct
  source 1..8: note = Description of Artificial Sequence: Synthetic peptide
GNWHYFDY

SEQ ID NO: 6010 - protein, 32 aa, synthetic construct; identical to SEQ ID NO: 6003
  source 1..32: note = Description of Artificial Sequence: Synthetic polypeptide

SEQ ID NO: 6011 - protein, 14 aa, synthetic construct
  source 1..14: note = Description of Artificial Sequence: Synthetic peptide
WIRQFPGKKLEWMG

SEQ ID NO: 6012 - protein, 32 aa, synthetic construct
  source 1..32: note = Description of Artificial Sequence: Synthetic polypeptide
RISITRDTSKNQFFLQLNSVTPEDTATYYCTR

SEQ ID NO: 6013 - protein, 11 aa, synthetic construct
  source 1..11: note = Description of Artificial Sequence: Synthetic peptide
WGQGTLVAVSS

SEQ ID NO: 6014 - protein, 32 aa, synthetic construct
  source 1..32: note = Description of Artificial Sequence: Synthetic polypeptide
QIQLQESGPGLVKPSETLSLTCTVSGFSINTG

SEQ ID NO: 6015 - protein, 14 aa, synthetic construct
  source 1..14: note = Description of Artificial Sequence: Synthetic peptide
WIRQPAGKGLEWIG

SEQ ID NO: 6016 - protein, 32 aa, synthetic construct
  source 1..32: note = Description of Artificial Sequence: Synthetic polypeptide
RVTMSRDTSKNQFSLKLSSVTAADTAVYYCAR

SEQ ID NO: 6017 - protein, 11 aa, synthetic construct
  source 1..11: note = Description of Artificial Sequence: Synthetic peptide
WGQGTMVTVSS

SEQ ID NO: 6018 - protein, 32 aa, synthetic construct
  source 1..32: note = Description of Artificial Sequence: Synthetic polypeptide
QIQLQESGPGLVKPSQTLSLTCTVSGFSINTG

SEQ ID NO: 6019 - protein, 14 aa, synthetic construct
  source 1..14: note = Description of Artificial Sequence: Synthetic peptide
WIRQHPGKGLEWIG

SEQ ID NO: 6020 - protein, 32 aa, synthetic construct
  source 1..32: note = Description of Artificial Sequence: Synthetic polypeptide
LVTISRDTSKNQFSLKLSSVTAADTAVYYCAR

SEQ ID NO: 6021 - protein, 11 aa, synthetic construct
  source 1..11: note = Description of Artificial Sequence: Synthetic peptide
WGQGTMVTVSS

SEQ ID NO: 6022 - protein, 32 aa, synthetic construct
  source 1..32: note = Description of Artificial Sequence: Synthetic polypeptide
EIQLLESGGGLVQPGGSLRLSCAVSGFSINTG

SEQ ID NO: 6023 - protein, 14 aa, synthetic construct
  source 1..14: note = Description of Artificial Sequence: Synthetic peptide
WVRQAPGKGLEWVG

SEQ ID NO: 6024 - protein, 32 aa, synthetic construct
  source 1..32: note = Description of Artificial Sequence: Synthetic polypeptide
RFTISRDTSKNTFYLQMNSLRAEDTAVYYCAR

SEQ ID NO: 6025 - protein, 11 aa, synthetic construct
  source 1..11: note = Description of Artificial Sequence: Synthetic peptide
WGQGTMVTVSS

SEQ ID NO: 6026 - protein, 32 aa, synthetic construct
  source 1..32: note = Description of Artificial Sequence: Synthetic polypeptide
QIQLVQSGAEVKKPGSSVKVSCKVSGFSINTG

SEQ ID NO: 6027 - protein, 14 aa, synthetic construct
  source 1..14: note = Description of Artificial Sequence: Synthetic peptide
WVRQAPGQGLEWMG

SEQ ID NO: 6028 - protein, 32 aa, synthetic construct
  source 1..32: note = Description of Artificial Sequence: Synthetic polypeptide
RVTITRDTSTNTFYMELSSLRSEDTAVYYCAR

SEQ ID NO: 6029 - protein, 11 aa, synthetic construct
  source 1..11: note = Description of Artificial Sequence: Synthetic peptide
WGQGTMVTVSS

SEQ ID NO: 6030 - protein, 32 aa, synthetic construct
  source 1..32: note = Description of Artificial Sequence: Synthetic polypeptide
EIQLVESGGGLVQPGGSLRLSCAVSGFSINTG

SEQ ID NO: 6031 - skipped

SEQ ID NO: 6032 - protein, 14 aa, synthetic construct
  source 1..14: note = Description of Artificial Sequence: Synthetic peptide
WVRQAPGKGLEWVG

SEQ ID NO: 6033 - protein, 32 aa, synthetic construct
  source 1..32: note = Description of Artificial Sequence: Synthetic polypeptide
RFTISRDTAKNSFYLQMNSLRAEDTAVYYCAR

SEQ ID NO: 6034 - protein, 11 aa, synthetic construct
  source 1..11: note = Description of Artificial Sequence: Synthetic peptide
WGQGTMVTVSS

SEQ ID NO: 6035 - protein, 32 aa, synthetic construct
  source 1..32: note = Description of Artificial Sequence: Synthetic polypeptide
QIQLVQSGAEVKKPGASVKVSCKVSGFSINTG

SEQ ID NO: 6036 - protein, 14 aa, synthetic construct
  source 1..14: note = Description of Artificial Sequence: Synthetic peptide
WVRQAPGQGLEWMG

SEQ ID NO: 6037 - protein, 32 aa, synthetic construct
  source 1..32: note = Description of Artificial Sequence: Synthetic polypeptide
RVTMTRDTSTNTFYMELSSLRSEDTAVYYCAR

SEQ ID NO: 6038 - protein, 11 aa, synthetic construct
  source 1..11: note = Description of Artificial Sequence: Synthetic peptide
WGQGTMVTVSS

SEQ ID NO: 6039 - protein, 32 aa, synthetic construct; identical to SEQ ID NO: 6018
  source 1..32: note = Description of Artificial Sequence: Synthetic polypeptide

SEQ ID NO: 6040 - protein, 14 aa, synthetic construct
  source 1..14: note = Description of Artificial Sequence: Synthetic peptide
WIRQHPGKGLEWIG

SEQ ID NO: 6041 - protein, 32 aa, synthetic construct; identical to SEQ ID NO: 6020
  source 1..32: note = Description of Artificial Sequence: Synthetic polypeptide

SEQ ID NO: 6042 - protein, 11 aa, synthetic construct
  source 1..11: note = Description of Artificial Sequence: Synthetic peptide
WGQGTLVTVSS

SEQ ID NO: 6043 - protein, 32 aa, synthetic construct; identical to SEQ ID NO: 6014
  source 1..32: note = Description of Artificial Sequence: Synthetic polypeptide

SEQ ID NO: 6044 - protein, 14 aa, synthetic construct
  source 1..14: note = Description of Artificial Sequence: Synthetic peptide
WIRQPAGKGLEWIG

SEQ ID NO: 6045 - protein, 32 aa, synthetic construct; identical to SEQ ID NO: 6016
  source 1..32: note = Description of Artificial Sequence: Synthetic polypeptide

SEQ ID NO: 6046 - protein, 11 aa, synthetic construct
  source 1..11: note = Description of Artificial Sequence: Synthetic peptide
WGQGTLVTVSS

SEQ ID NO: 6047 - protein, 32 aa, synthetic construct; identical to SEQ ID NO: 6022
  source 1..32: note = Description of Artificial Sequence: Synthetic polypeptide

SEQ ID NO: 6048 - protein, 14 aa, synthetic construct
  source 1..14: note = Description of Artificial Sequence: Synthetic peptide
WVRQAPGKGLEWVG

SEQ ID NO: 6049 - protein, 32 aa, synthetic construct; identical to SEQ ID NO: 6024
  source 1..32: note = Description of Artificial Sequence: Synthetic polypeptide

SEQ ID NO: 6050 - protein, 11 aa, synthetic construct
  source 1..11: note = Description of Artificial Sequence: Synthetic peptide
WGQGTLVTVSS

SEQ ID NO: 6051 - protein, 32 aa, synthetic construct
  source 1..32: note = Description of Artificial Sequence: Synthetic polypeptide
QIQLVESGGGLVKPGGSLRLSCAVSGFSINTG

SEQ ID NO: 6052 - protein, 14 aa, synthetic construct
  source 1..14: note = Description of Artificial Sequence: Synthetic peptide
WIRQAPGKGLEWVG

SEQ ID NO: 6053 - protein, 32 aa, synthetic construct; identical to SEQ ID NO: 6033
  source 1..32: note = Description of Artificial Sequence: Synthetic polypeptide

SEQ ID NO: 6054 - protein, 11 aa, synthetic construct
  source 1..11: note = Description of Artificial Sequence: Synthetic peptide
WGQGTLVTVSS

SEQ ID NO: 6055 - protein, 32 aa, synthetic construct; identical to SEQ ID NO: 6035
  source 1..32: note = Description of Artificial Sequence: Synthetic polypeptide

SEQ ID NO: 6056 - protein, 14 aa, synthetic construct
  source 1..14: note = Description of Artificial Sequence: Synthetic peptide
WVRQAPGQGLEWMG

SEQ ID NO: 6057 - protein, 32 aa, synthetic construct; identical to SEQ ID NO: 6037
  source 1..32: note = Description of Artificial Sequence: Synthetic polypeptide

SEQ ID NO: 6058 - protein, 11 aa, synthetic construct
  source 1..11: note = Description of Artificial Sequence: Synthetic peptide
WGQGTLVTVSS

SEQ ID NO: 6059 - protein, 32 aa, synthetic construct
  source 1..32: note = Description of Artificial Sequence: Synthetic polypeptide
EIQLVQSGAEVKKPGATVKISCKVSGFSINTG

SEQ ID NO: 6060 - protein, 14 aa, synthetic construct
  source 1..14: note = Description of Artificial Sequence: Synthetic peptide
WVQQAPGKGLEWMG

SEQ ID NO: 6061 - protein, 32 aa, synthetic construct; identical to SEQ ID NO: 6028
  source 1..32: note = Description of Artificial Sequence: Synthetic polypeptide

SEQ ID NO: 6062 - protein, 11 aa, synthetic construct
  source 1..11: note = Description of Artificial Sequence: Synthetic peptide
WGQGTLVTVSS

SEQ ID NO: 6063 - protein, 11 aa, synthetic construct
  source 1..11: note = Description of Artificial Sequence: Synthetic peptide
SGERLSDKYVH

SEQ ID NO: 6064 - protein, 7 aa, synthetic construct
  source 1..7: note = Description of Artificial Sequence: Synthetic peptide
ENDKRPS

SEQ ID NO: 6065 - skipped

SEQ ID NO: 6066 - protein, 22 aa, synthetic construct
  source 1..22: note = Description of Artificial Sequence: Synthetic peptide
SYTLTQPPLLSVALGHKATITC

SEQ ID NO: 6067 - protein, 15 aa, synthetic construct
  source 1..15: note = Description of Artificial Sequence: Synthetic peptide
WYQQKPGRAPVMVIY

SEQ ID NO: 6068 - skipped

SEQ ID NO: 6069 - protein, 10 aa, synthetic construct
  source 1..10: note = Description of Artificial Sequence: Synthetic peptide
FGSGTQLTVL

SEQ ID NO: 6070 - protein, 11 aa, synthetic construct
  source 1..11: note = Description of Artificial Sequence: Synthetic peptide
SGENLSDKYVH

SEQ ID NO: 6071 - protein, 7 aa, synthetic construct
  source 1..7: note = Description of Artificial Sequence: Synthetic peptide
ENEKRPS

SEQ ID NO: 6072 - protein, 10 aa, synthetic construct
  source 1..10: note = Description of Artificial Sequence: Synthetic peptide
HYWESINSVV

SEQ ID NO: 6073 - protein, 22 aa, synthetic construct
  source 1..22: note = Description of Artificial Sequence: Synthetic peptide
SYTLTQPPSLSVAPGQKATIIC

SEQ ID NO: 6074 - protein, 15 aa, synthetic construct
  source 1..15: note = Description of Artificial Sequence: Synthetic peptide
WYQQKPGRAPVMVIY

SEQ ID NO: 6075 - protein, 32 aa, synthetic construct
  source 1..32: note = Description of Artificial Sequence: Synthetic polypeptide
GIPDQFSGSNSGNIATLTISKAQPGSEADYYC

SEQ ID NO: 6076 - protein, 10 aa, synthetic construct
  source 1..10: note = Description of Artificial Sequence: Synthetic peptide
FGSGTHLTVL

SEQ ID NO: 6077 - protein, 22 aa, synthetic construct
  source 1..22: note = Description of Artificial Sequence: Synthetic peptide
QSVTTQPPSVSGAPGQRVTISC

SEQ ID NO: 6078 - protein, 15 aa, synthetic construct
  source 1..15: note = Description of Artificial Sequence: Synthetic peptide
WYQQLPGTAPKMLIY

SEQ ID NO: 6079 - protein, 32 aa, synthetic construct
  source 1..32: note = Description of Artificial Sequence: Synthetic polypeptide
GVPDRFSGSNSGNSASLAITGLQAEDEADYYC

SEQ ID NO: 6080 - protein, 10 aa, synthetic construct
  source 1..10: note = Description of Artificial Sequence: Synthetic peptide
FGGGTQLTVL

SEQ ID NO: 6081 - protein, 22 aa, synthetic construct
  source 1..22: note = Description of Artificial Sequence: Synthetic peptide
QSVTTQPPSASGTPGQRVTISC

SEQ ID NO: 6082 - protein, 15 aa, synthetic construct
  source 1..15: note = Description of Artificial Sequence: Synthetic peptide
WYQQLPGTAPKMLIY

SEQ ID NO: 6083 - protein, 32 aa, synthetic construct
  source 1..32: note = Description of Artificial Sequence: Synthetic polypeptide
GVPDRFSGSNSGNSASLAISGLQSEDEADYYC

SEQ ID NO: 6084 - protein, 10 aa, synthetic construct
  source 1..10: note = Description of Artificial Sequence: Synthetic peptide
FGGGTQLTVL

SEQ ID NO: 6085 - protein, 22 aa, synthetic construct
  source 1..22: note = Description of Artificial Sequence: Synthetic peptide
QSVTTQPPSASGTPGQRVTISC

SEQ ID NO: 6086 - protein, 15 aa, synthetic construct
  source 1..15: note = Description of Artificial Sequence: Synthetic peptide
WYQQLPGTAPKMLIY

SEQ ID NO: 6087 - protein, 32 aa, synthetic construct
  source 1..32: note = Description of Artificial Sequence: Synthetic polypeptide
GVPDRFSGSNSGNSASLAISGLRSEDEADYYC

SEQ ID NO: 6088 - protein, 10 aa, synthetic construct
  source 1..10: note = Description of Artificial Sequence: Synthetic peptide
FGGGTQLTVL

SEQ ID NO: 6089 - protein, 22 aa, synthetic construct
  source 1..22: note = Description of Artificial Sequence: Synthetic peptide
SSETTQPHSVSVATAQMARITC

SEQ ID NO: 6090 - protein, 15 aa, synthetic construct
  source 1..15: note = Description of Artificial Sequence: Synthetic peptide
WYQQKPGQDPVMVIY

SEQ ID NO: 6091 - protein, 32 aa, synthetic construct
  source 1..32: note = Description of Artificial Sequence: Synthetic polypeptide
GIPERFSGSNPGNTATLTISRIEAGDEADYYC

SEQ ID NO: 6092 - protein, 10 aa, synthetic construct
  source 1..10: note = Description of Artificial Sequence: Synthetic peptide
FGGGTQLTVL

SEQ ID NO: 6093 - protein, 23 aa, synthetic construct
  source 1..23: note = Description of Artificial Sequence: Synthetic peptide
DIQMTQSPSTLSASVGDRVTITC

SEQ ID NO: 6094 - protein, 15 aa, synthetic construct
  source 1..15: note = Description of Artificial Sequence: Synthetic peptide
WYQQKPGKAPKMLIY

SEQ ID NO: 6095 - protein, 32 aa, synthetic construct
  source 1..32: note = Description of Artificial Sequence: Synthetic polypeptide
GVPSRFSGSNSGNEATLTISSLQPDDFATYYC

SEQ ID NO: 6096 - protein, 10 aa, synthetic construct
  source 1..10: note = Description of Artificial Sequence: Synthetic peptide
FGQGTKVEIK

SEQ ID NO: 6097 - protein, 22 aa, synthetic construct
  source 1..22: note = Description of Artificial Sequence: Synthetic peptide
QYVLTQPPSASGTPGQRVTISC

SEQ ID NO: 6098 - protein, 15 aa, synthetic construct
  source 1..15: note = Description of Artificial Sequence: Synthetic peptide
WYQQLPGTAPKMLIY

SEQ ID NO: 6099 - protein, 32 aa, synthetic construct; identical to SEQ ID NO: 6083
  source 1..32: note = Description of Artificial Sequence: Synthetic polypeptide

SEQ ID NO: 6100 - protein, 10 aa, synthetic construct
  source 1..10: note = Description of Artificial Sequence: Synthetic peptide
FGEGTELTVL

SEQ ID NO: 6101 - protein, 22 aa, synthetic construct
  source 1..22: note = Description of Artificial Sequence: Synthetic peptide
QYVLTQPPSASGTPGQRVTISC

SEQ ID NO: 6102 - protein, 15 aa, synthetic construct
  source 1..15: note = Description of Artificial Sequence: Synthetic peptide
WYQQLPGTAPKMLIY

SEQ ID NO: 6103 - protein, 32 aa, synthetic construct; identical to SEQ ID NO: 6087
  source 1..32: note = Description of Artificial Sequence: Synthetic polypeptide

SEQ ID NO: 6104 - protein, 10 aa, synthetic construct
  source 1..10: note = Description of Artificial Sequence: Synthetic peptide
FGEGTELTVL

SEQ ID NO: 6105 - protein, 22 aa, synthetic construct
  source 1..22: note = Description of Artificial Sequence: Synthetic peptide
SYELTQPPSVSVSPGQTASITC

SEQ ID NO: 6106 - protein, 15 aa, synthetic construct
  source 1..15: note = Description of Artificial Sequence: Synthetic peptide
WYQQKPGQSPVMVIY

SEQ ID NO: 6107 - protein, 32 aa, synthetic construct
  source 1..32: note = Description of Artificial Sequence: Synthetic polypeptide
GIPERFSGSNSGNTATLTISGTQAMDEADYYC

SEQ ID NO: 6108 - protein, 10 aa, synthetic construct
  source 1..10: note = Description of Artificial Sequence: Synthetic peptide
FGEGTELTVL

SEQ ID NO: 6109 - protein, 23 aa, synthetic construct
  source 1..23: note = Description of Artificial Sequence: Synthetic peptide
DYVLTQSPLSLPVTPGEPASISC

SEQ ID NO: 6110 - protein, 15 aa, synthetic construct
  source 1..15: note = Description of Artificial Sequence: Synthetic peptide
WYLQKPGQSPQMLIY

SEQ ID NO: 6111 - protein, 32 aa, synthetic construct
  source 1..32: note = Description of Artificial Sequence: Synthetic polypeptide
GVPDRFSGSNSGNDATLKISRVEAEDVGVYYC

SEQ ID NO: 6112 - protein, 10 aa, synthetic construct
  source 1..10: note = Description of Artificial Sequence: Synthetic peptide
FGQGTKVEIK

SEQ ID NO: 6113 - protein, 23 aa, synthetic construct
  source 1..23: note = Description of Artificial Sequence: Synthetic peptide
AYQLTQSPSSLSASVGDRVTITC

SEQ ID NO: 6114 - protein, 15 aa, synthetic construct
  source 1..15: note = Description of Artificial Sequence: Synthetic peptide
WYQQKPGKAPKMLIY

SEQ ID NO: 6115 - protein, 32 aa, synthetic construct
  source 1..32: note = Description of Artificial Sequence: Synthetic polypeptide
GVPSRFSGSNSGNDATLTISSLQPEDFATYYC

SEQ ID NO: 6116 - protein, 10 aa, synthetic construct
  source 1..10: note = Description of Artificial Sequence: Synthetic peptide
FGQGTKVEIK

SEQ ID NO: 6117 - protein, 23 aa, synthetic construct
  source 1..23: note = Description of Artificial Sequence: Synthetic peptide
EYVLTQSPATLSVSPGERATLSC

SEQ ID NO: 6118 - protein, 15 aa, synthetic construct
  source 1..15: note = Description of Artificial Sequence: Synthetic peptide
WYQQKPGQAPRMLIY

SEQ ID NO: 6119 - protein, 32 aa, synthetic construct
  source 1..32: note = Description of Artificial Sequence: Synthetic polypeptide
GIPARFSGSNSGNEATLTISSLQSEDFAVYYC

SEQ ID NO: 6120 - protein, 10 aa, synthetic construct
  source 1..10: note = Description of Artificial Sequence: Synthetic peptide
FGQGTKVEIK

SEQ ID NO: 6121 - protein, 118 aa, synthetic construct
  source 1..118: note = Description of Artificial Sequence: Synthetic polypeptide
QIQLQESGPGLVKPSQSLSLTCSVTGFSINTGGYHWNWIRQFPGKKLEWMGYIYSSGSTSYNPSLKSRISITRDTSKNQFFLQLNSVTTEDTATYYCARGNWHYFDFWGQGTMVTVSS

SEQ ID NO: 6122 - protein, 118 aa, synthetic construct
  source 1..118: note = Description of Artificial Sequence: Synthetic polypeptide
QIQLQESGPGLVKPSQSLSLTCSVTGFSINTGGYHWNWIRQFPGKKLEWMGYIYSSGTTRYNPSLKSRISITRDTSKNQFFLQLNSVTPEDTATYYCTRGNWHYFDYWGQGTLVAVSS

SEQ ID NO: 6123 - protein, 118 aa, synthetic construct
  source 1..118: note = Description of Artificial Sequence: Synthetic polypeptide
QIQLQESGPGLVKPSETLSLTCTVSGFSINTGGYHWNWIRQPAGKGLEWIGYIYSSGSTSYNPSLKSRVTMSRDTSKNQFSLKLSSVTAADTAVYYCARGNWHYFDFWGQGTMVTVSS

SEQ ID NO: 6124 - protein, 118 aa, synthetic construct
  source 1..118: note = Description of Artificial Sequence: Synthetic polypeptide
QIQLQESGPGLVKPSQTLSLTCTVSGFSINTGGYHWNWIRQHPGKGLEWIGYIYSSGSTSYNPSLKSLVTISRDTSKNQFSLKLSSVTAADTAVYYCARGNWHYFDFWGQGTMVTVSS

SEQ ID NO: 6125 - protein, 118 aa, synthetic construct
  source 1..118: note = Description of Artificial Sequence: Synthetic polypeptide
EIQLLESGGGLVQPGGSLRLSCAVSGFSINTGGYHWNWVRQAPGKGLEWVGYIYSSGSTSYNPSLKSRFTISRDTSKNTFYLQMNSLRAEDTAVYYCARGNWHYFDFWGQGTMVTVSS

SEQ ID NO: 6126 - protein, 118 aa, synthetic construct
  source 1..118: note = Description of Artificial Sequence: Synthetic polypeptide
QIQLVQSGAEVKKPGSSVKVSCKVSGFSINTGGYHWNWVRQAPGQGLEWMGYIYSSGSTSYNPSLKSRVTITRDTSTNTFYMELSSLRSEDTAVYYCARGNWHYFDFWGQGTMVTVSS

SEQ ID NO: 6127 - protein, 118 aa, synthetic construct
  source 1..118: note = Description of Artificial Sequence: Synthetic polypeptide
EIQLVESGGGLVQPGGSLRLSCAVSGFSINTGGYHWNWVRQAPGKGLEWVGYIYSSGSTSYNPSLKSRFTISRDTAKNSFYLQMNSLRAEDTAVYYCARGNWHYFDFWGQGTMVTVSS

SEQ ID NO: 6128 - protein, 118 aa, synthetic construct
  source 1..118: note = Description of Artificial Sequence: Synthetic polypeptide
QIQLVQSGAEVKKPGASVKVSCKVSGFSINTGGYHWNWVRQAPGQGLEWMGYIYSSGSTSYNPSLKSRVTMTRDTSTNTFYMELSSLRSEDTAVYYCARGNWHYFDFWGQGTMVTVSS

SEQ ID NO: 6129 - protein, 118 aa, synthetic construct
  source 1..118: note = Description of Artificial Sequence: Synthetic polypeptide
QIQLQESGPGLVKPSQTLSLTCTVSGFSINTGGYHWNWIRQHPGKGLEWIGYIYSSGTTRYNPSLKSLVTISRDTSKNQFSLKLSSVTAADTAVYYCARGNWHYFDYWGQGTLVTVSS

SEQ ID NO: 6130 - protein, 118 aa, synthetic construct
  source 1..118: note = Description of Artificial Sequence: Synthetic polypeptide
QIQLQESGPGLVKPSETLSLTCTVSGFSINTGGYHWNWIRQPAGKGLEWIGYIYSSGTTRYNPSLKSRVTMSRDTSKNQFSLKLSSVTAADTAVYYCARGNWHYFDYWGQGTLVTVSS

SEQ ID NO: 6131 - protein, 118 aa, synthetic construct
  source 1..118: note = Description of Artificial Sequence: Synthetic polypeptide
EIQLLESGGGLVQPGGSLRLSCAVSGFSINTGGYHWNWVRQAPGKGLEWVGYIYSSGTTRYNPSLKSRFTISRDTSKNTFYLQMNSLRAEDTAVYYCARGNWHYFDYWGQGTLVTVSS

SEQ ID NO: 6132 - protein, 118 aa, synthetic construct
  source 1..118: note = Description of Artificial Sequence: Synthetic polypeptide
QIQLVESGGGLVKPGGSLRLSCAVSGFSINTGGYHWNWIRQAPGKGLEWVGYIYSSGTTRYNPSLKSRFTISRDTAKNSFYLQMNSLRAEDTAVYYCARGNWHYFDYWGQGTLVTVSS

SEQ ID NO: 6133 - protein, 118 aa, synthetic construct
  source 1..118: note = Description of Artificial Sequence: Synthetic polypeptide
QIQLVQSGAEVKKPGASVKVSCKVSGFSINTGGYHWNWVRQAPGQGLEWMGYIYSSGTTRYNPSLKSRVTMTRDTSTNTFYMELSSLRSEDTAVYYCARGNWHYFDYWGQGTLVTVSS

SEQ ID NO: 6134 - protein, 118 aa, synthetic construct
  source 1..118: note = Description of Artificial Sequence: Synthetic polypeptide
EIQLVQSGAEVKKPGATVKISCKVSGFSINTGGYHWNWVQQAPGKGLEWMGYIYSSGTTRYNPSLKSRVTITRDTSTNTFYMELSSLRSEDTAVYYCARGNWHYFDYWGQGTLVTVSS

SEQ ID NO: 6135 - skipped

SEQ ID NO: 6136 - protein, 107 aa, synthetic construct
  source 1..107: note = Description of Artificial Sequence: Synthetic polypeptide
SYTLTQPPSLSVAPGQKATIICSGENLSDKYVHWYQQKPGRAPVMVIYENEKRPSGIPDQFSGSNSGNIATLTISKAQPGSEADYYCHYWESINSVVFGSGTHLTVL

SEQ ID NO: 6137 - protein, 107 aa, synthetic construct
  source 1..107: note = Description of Artificial Sequence: Synthetic polypeptide
QSVTTQPPSVSGAPGQRVTISCSGERLSDKYVHWYQQLPGTAPKMLIYENDKRPSGVPDRFSGSNSGNSASLAITGLQAEDEADYYCQSWDSTNSAVFGGGTQLTVL

SEQ ID NO: 6138 - protein, 107 aa, synthetic construct
  source 1..107: note = Description of Artificial Sequence: Synthetic polypeptide
QSVTTQPPSASGTPGQRVTISCSGERLSDKYVHWYQQLPGTAPKMLIYENDKRPSGVPDRFSGSNSGNSASLAISGLQSEDEADYYCQSWDSTNSAVFGGGTQLTVL

SEQ ID NO: 6139 - protein, 107 aa, synthetic construct
  source 1..107: note = Description of Artificial Sequence: Synthetic polypeptide
QSVTTQPPSASGTPGQRVTISCSGERLSDKYVHWYQQLPGTAPKMLIYENDKRPSGVPDRFSGSNSGNSASLAISGLRSEDEADYYCQSWDSTNSAVFGGGTQLTVL

SEQ ID NO: 6140 - protein, 107 aa, synthetic construct
  source 1..107: note = Description of Artificial Sequence: Synthetic polypeptide
SSETTQPHSVSVATAQMARITCSGERLSDKYVHWYQQKPGQDPVMVIYENDKRPSGIPERFSGSNPGNTATLTISRIEAGDEADYYCQSWDSTNSAVFGGGTQLTVL

SEQ ID NO: 6141 - protein, 108 aa, synthetic construct
  source 1..108: note = Description of Artificial Sequence: Synthetic polypeptide
DIQMTQSPSTLSASVGDRVTITCSGERLSDKYVHWYQQKPGKAPKMLIYENDKRPSGVPSRFSGSNSGNEATLTISSLQPDDFATYYCQSWDSTNSAVFGQGTKVEIK

SEQ ID NO: 6142 - protein, 107 aa, synthetic construct
  source 1..107: note = Description of Artificial Sequence: Synthetic polypeptide
QYVLTQPPSASGTPGQRVTISCSGENLSDKYVHWYQQLPGTAPKMLIYENEKRPSGVPDRFSGSNSGNSASLAISGLQSEDEADYYCHYWESINSVVFGEGTELTVL

SEQ ID NO: 6143 - protein, 107 aa, synthetic construct
  source 1..107: note = Description of Artificial Sequence: Synthetic polypeptide
QYVLTQPPSASGTPGQRVTISCSGENLSDKYVHWYQQLPGTAPKMLIYENEKRPSGVPDRFSGSNSGNSASLAISGLRSEDEADYYCHYWESINSVVFGEGTELTVL

SEQ ID NO: 6144 - protein, 107 aa, synthetic construct
  source 1..107: note = Description of Artificial Sequence: Synthetic polypeptide
SYELTQPPSVSVSPGQTASITCSGENLSDKYVHWYQQKPGQSPVMVIYENEKRPSGIPERFSGSNSGNTATLTISGTQAMDEADYYCHYWESINSVVFGEGTELTVL

SEQ ID NO: 6145 - protein, 108 aa, synthetic construct
  source 1..108: note = Description of Artificial Sequence: Synthetic polypeptide
DYVLTQSPLSLPVTPGEPASISCSGENLSDKYVHWYLQKPGQSPQMLIYENEKRPSGVPDRFSGSNSGNDATLKISRVEAEDVGVYYCHYWESINSVVFGQGTKVEIK

SEQ ID NO: 6146 - protein, 108 aa, synthetic construct
  source 1..108: note = Description of Artificial Sequence: Synthetic polypeptide
AYQLTQSPSSLSASVGDRVTITCSGENLSDKYVHWYQQKPGKAPKMLIYENEKRPSGVPSRFSGSNSGNDATLTISSLQPEDFATYYCHYWESINSVVFGQGTKVEIK

SEQ ID NO: 6147 - protein, 108 aa, synthetic construct
  source 1..108: note = Description of Artificial Sequence: Synthetic polypeptide
EYVLTQSPATLSVSPGERATLSCSGENLSDKYVHWYQQKPGQAPRMLIYENEKRPSGIPARFSGSNSGNEATLTISSLQSEDFAVYYCHYWESINSVVFGQGTKVEIK

SEQ ID NO: 6148 - protein, 448 aa, synthetic construct
  source 1..448: note = Description of Artificial Sequence: Synthetic polypeptide
QIQLQESGPGLVKPSQSLSLTCSVTGFSINTGGYHWNWIRQFPGKKLEWMGYIYSSGSTSYNPSLKSRISITRDTSKNQFFLQLNSVTTEDTATYYCARGNWHYFDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 6149 - protein, 448 aa, synthetic construct
  source 1..448: note = Description of Artificial Sequence: Synthetic polypeptide
QIQLQESGPGLVKPSQSLSLTCSVTGFSINTGGYHWNWIRQFPGKKLEWMGYIYSSGSTSYNPSLKSRISITRDTSKNQFFLQLNSVTTEDTATYYCARGNWHYFDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 6150 - protein, 213 aa, synthetic construct
  source 1..213: note = Description of Artificial Sequence: Synthetic polypeptide
SYTLTQPPLLSVALGHKATITCSGERLSDKYVHWYQQKPGRAPVMVIYENDKRPSGIPDQFSGSNSGNIATLTISKAQAGYEADYYCQSWDSTNSAVFGSGTQLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 6151 - protein, 448 aa, synthetic construct
  source 1..448: note = Description of Artificial Sequence: Synthetic polypeptide
QIQLQESGPGLVKPSQSLSLTCSVTGFSINTGGYHWNWIRQFPGKKLEWMGYIYSSGTTRYNPSLKSRISITRDTSKNQFFLQLNSVTPEDTATYYCTRGNWHYFDYWGQGTLVAVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 6152 - protein, 448 aa, synthetic construct
  source 1..448: note = Description of Artificial Sequence: Synthetic polypeptide
QIQLQESGPGLVKPSQSLSLTCSVTGFSINTGGYHWNWIRQFPGKKLEWMGYIYSSGTTRYNPSLKSRISITRDTSKNQFFLQLNSVTPEDTATYYCTRGNWHYFDYWGQGTLVAVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 6153 - protein, 213 aa, synthetic construct
  source 1..213: note = Description of Artificial Sequence: Synthetic polypeptide
SYTLTQPPSLSVAPGQKATIICSGENLSDKYVHWYQQKPGRAPVMVIYENEKRPSGIPDQFSGSNSGNIATLTISKAQPGSEADYYCHYWESINSVVFGSGTHLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 6154 - protein, 454 aa, synthetic construct
  source 1..454: note = Description of Artificial Sequence: Synthetic polypeptide
EVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6155 - protein, 454 aa, synthetic construct
  source 1..454: note = Description of Artificial Sequence: Synthetic polypeptide
EVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6156 - protein, 219 aa, synthetic construct
  source 1..219: note = Description of Artificial Sequence: Synthetic polypeptide
DVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6157 - protein, 440 aa, synthetic construct
  source 1..440: note = Description of Artificial Sequence: Synthetic polypeptide
METDTLLLWVLLLWVPGSTGDYKDDDDKGGGGSGTGGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGSGNGTSNGTSGSSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6158 - protein, 601 aa, synthetic construct
  source 1..601: note = Description of Artificial Sequence: Synthetic polypeptide
METDTLLLWVLLLWVPGSTGDYKDDDDKGGGGSGTGGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGSGNGTSNGTSGSSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6159 - protein, 762 aa, synthetic construct
  source 1..762: note = Description of Artificial Sequence: Synthetic polypeptide
METDTLLLWVLLLWVPGSTGDYKDDDDKGGGGSGTGGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGSGNGTSNGTSGSSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6160 - protein, 444 aa, synthetic construct
  source 1..444: note = Description of Artificial Sequence: Synthetic polypeptide
METDTLLLWVLLLWVPGSTGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6161 - protein, 642 aa, synthetic construct
  source 1..642: note = Description of Artificial Sequence: Synthetic polypeptide
METDTLLLWVLLLWVPGSTGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6162 - protein, 840 aa, synthetic construct
  source 1..840: note = Description of Artificial Sequence: Synthetic polypeptide
METDTLLLWVLLLWVPGSTGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6163 - protein, 502 aa, synthetic construct
  source 1..502: note = Description of Artificial Sequence: Synthetic polypeptide
METDTLLLWVLLLWVPGSTGEVQLVESGGGLVQPGGSLRLSCAASGFTFSSYVMSWVRQAPGKGLEWVATISSGGSYTYYPDSVKGRFTISRDNAKNTLYLQMNSLRAEDTAVYYCARRGDSMITTDYWGQGTLVTVSSGGGGSGGGGSGGGGSGGGGSDIQMTQSPSSLSASVGDRVTITCKASQDVGTAVAWYQQKPGKAPKLLIYWASTRHTGVPSRFSGSGSGTDFTLTISSLQPEDFATYYCQQYSSYRTFGQGTKVEIKGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6164 - protein, 505 aa, synthetic construct
  source 1..505: note = Description of Artificial Sequence: Synthetic polypeptide
METDTLLLWVLLLWVPGSTGEVQLVQSGGGVERPGGSLRLSCAASGFTFDDYAMSWVRQAPGKGLEWVSGINWQGGSTGYADSVKGRVTISRDNAKNSLYLQMNSLRAEDTAVYYCAKILGAGRGWYFDYWGKGTTVTVSSGGGGSGGGGSGGGGSGGGGSSELTQDPAVSVALGQTVRITCSGDSLRSYYASWYQQKPGQAPVLVIYGANNRPSGIPDRFSGSSSGNTASLTITGAQAEDEADYYCNSADSSGNHVVFGGGTKLTVLGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6165 - protein, 508 aa, synthetic construct
  source 1..508: note = Description of Artificial Sequence: Synthetic polypeptide
METDTLLLWVLLLWVPGSTGQVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYYYGMDVWGQGTTVTVSSGGGGSGGGGSGGGGSGGGGSEIVLTQSPGTLSLSPGERATLSCRASQGISRSYLAWYQQKPGQAPSLLIYGASSRATGIPDRFSGSGSGTDFTLTISRLEPEDFAVYYCQQFGSSPWTFGQGTKVEIKRGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6166 - skipped

SEQ ID NO: 6167 - protein, 474 aa, synthetic construct
  source 1..474: note = Description of Artificial Sequence: Synthetic polypeptide
METDTLLLWVLLLWVPGSTGQVQLVQSGAEVKKPGSSVKVSCKASGYTFTGYVMHWVRQAPGQGLEWMGFINPYNDDIQSNERFRGRVTITSDKSTTTAYMELSSLRSEDTAVYYCARGAGYNFDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 6168 - protein, 474 aa, synthetic construct
  source 1..474: note = Description of Artificial Sequence: Synthetic polypeptide
METDTLLLWVLLLWVPGSTGQVQLVQSGAEVKKPGSSVKVSCKASGYTFTGYVMHWVRQAPGQGLEWMGFINPYNDDIQSNERFRGRVTITSDKSTTTAYMELSSLRSEDTAVYYCARGAGYNFDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6169 - protein, 239 aa, synthetic construct
  source 1..239: note = Description of Artificial Sequence: Synthetic polypeptide
METDTLLLWVLLLWVPGSTGDVVMTQSPLSLPVTLGQPASISCRSSQRLVHSNGNTYLHWYQQRPGQSPRLLIYRVSNRFPGVPDRFSGSGSGTDFTLKISRVEAEDVGVYFCSQSTHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6170 - protein, 499 aa, synthetic construct
  source 1..499: note = Description of Artificial Sequence: Synthetic polypeptide
METDTLLLWVLLLWVPGSTGDVVMTQSPLSLPVTPGEPASISCRSSQRLVHSNGNTYLHWYLQKPGQSPQLLIYRVSNRFPGVPDRFSGSGSGTDFTLKISRVEAEDVGVYFCSQSTHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSEVQLVESGGGLVQPGGSLRLSCAASGFTFSSYVMSWVRQAPGKGLEWVATISSGGSYTYYPDSVKGRFTISRDNAKNTLYLQMNSLRAEDTAVYYCARRGDSMITTDYWGQGTLVTVSSGGGGSGGGGSGGGGSGGGGSDIQMTQSPSSLSASVGDRVTITCKASQDVGTAVAWYQQKPGKAPKLLIYWASTRHTGVPSRFSGSGSGTDFTLTISSLQPEDFATYYCQQYSSYRTFGQGTKVEIK

SEQ ID NO: 6171 - protein, 505 aa, synthetic construct
  source 1..505: note = Description of Artificial Sequence: Synthetic polypeptide
METDTLLLWVLLLWVPGSTGDVVMTQSPLSLPVTPGEPASISCRSSQRLVHSNGNTYLHWYLQKPGQSPQLLIYRVSNRFPGVPDRFSGSGSGTDFTLKISRVEAEDVGVYFCSQSTHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSQVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYYYGMDVWGQGTTVTVSSGGGGSGGGGSGGGGSGGGGSEIVLTQSPGTLSLSPGERATLSCRASQGISRSYLAWYQQKPGQAPSLLIYGASSRATGIPDRFSGSGSGTDFTLTISRLEPEDFAVYYCQQFGSSPWTFGQGTKVEIKR

SEQ ID NO: 6172 - protein, 502 aa, synthetic construct
  source 1..502: note = Description of Artificial Sequence: Synthetic polypeptide
METDTLLLWVLLLWVPGSTGDVVMTQSPLSLPVTPGEPASISCRSSQRLVHSNGNTYLHWYLQKPGQSPQLLIYRVSNRFPGVPDRFSGSGSGTDFTLKISRVEAEDVGVYFCSQSTHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSEVQLVQSGGGVERPGGSLRLSCAASGFTFDDYAMSWVRQAPGKGLEWVSGINWQGGSTGYADSVKGRVTISRDNAKNSLYLQMNSLRAEDTAVYYCAKILGAGRGWYFDYWGKGTTVTVSSGGGGSGGGGSGGGGSGGGGSSELTQDPAVSVALGQTVRITCSGDSLRSYYASWYQQKPGQAPVLVIYGANNRPSGIPDRFSGSSSGNTASLTITGAQAEDEADYYCNSADSSGNHVVFGGGTKLTVL

SEQ ID NO: 6173 - protein, 597 aa, synthetic construct
  source 1..597: note = Description of Artificial Sequence: Synthetic polypeptide
METDTLLLWVLLLWVPGSTGQVQLVQSGAEVKKPGSSVKVSCKASGYTFTGYVMHWVRQAPGQGLEWMGFINPYNDDIQSNERFRGRVTITSDKSTTTAYMELSSLRSEDTAVYYCARGAGYNFDGAYRFFDFWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLGQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 6174 - protein, 159 aa, synthetic construct
  source 1..159: note = Description of Artificial Sequence: Synthetic polypeptide
MKNHLLFWGVLAVFIKAVHVKAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVETALTPDACYPD

SEQ ID NO: 6175 - protein, 243 aa, synthetic construct
  source 1..243: note = Description of Artificial Sequence: Synthetic polypeptide
QVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSGGGGSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 6176 - protein, 115 aa, synthetic construct
  source 1..115: note = Description of Artificial Sequence: Synthetic polypeptide
QVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSS

SEQ ID NO: 6177 - protein, 108 aa, synthetic construct
  source 1..108: note = Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 6178 - protein, 250 aa, synthetic construct
  source 1..250: note = Description of Artificial Sequence: Synthetic polypeptide
EVQLVQSGAEVKEPGESLKISCKNSGYSFTNYWVGWVRQMPGKGLEWMGIIYPGDSDTRYSPSFQGQVTISADKSINTAYLQWSSLKASDTAMYYCGRLTMFRGIIIGYFDYWGQGTLVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPWTFGQGTKVEIK

SEQ ID NO: 6179 - protein, 123 aa, synthetic construct
  source 1..123: note = Description of Artificial Sequence: Synthetic polypeptide
EVQLVQSGAEVKEPGESLKISCKNSGYSFTNYWVGWVRQMPGKGLEWMGIIYPGDSDTRYSPSFQGQVTISADKSINTAYLQWSSLKASDTAMYYCGRLTMFRGIIIGYFDYWGQGTLVTVSS

SEQ ID NO: 6180 - protein, 107 aa, synthetic construct
  source 1..107: note = Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPWTFGQGTKVEIK

SEQ ID NO: 6181 - protein, 247 aa, synthetic construct
  source 1..247: note = Description of Artificial Sequence: Synthetic polypeptide
QVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSSGGGGSGGGGSGGGGSGGGGSDIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIK

SEQ ID NO: 6182 - protein, 120 aa, synthetic construct
  source 1..120: note = Description of Artificial Sequence: Synthetic polypeptide
QVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSS

SEQ ID NO: 6183 - protein, 107 aa, synthetic construct
  source 1..107: note = Description of Artificial Sequence: Synthetic polypeptide
DIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIK

SEQ ID NO: 6184 - protein, 239 aa, synthetic construct
  source 1..239: note = Description of Artificial Sequence: Synthetic polypeptide
EVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARGRSLLFDYWGQGTLVTVSRGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 6185 - protein, 117 aa, synthetic construct
  source 1..117: note = Description of Artificial Sequence: Synthetic polypeptide
EVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARGRSLLFDYWGQGTLVTVSR

SEQ ID NO: 6186 - protein, 108 aa, synthetic construct
  source 1..108: note = Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 6187 - protein, 245 aa, synthetic construct
  source 1..245: note = Description of Artificial Sequence: Synthetic polypeptide
QIQLQESGPGLVKPSQSLSLTCSVTGFSINTGGYHWNWIRQFPGKKLEWMGYIYSSGSTSYNPSLKSRISITRDTSKNQFFLQLNSVTTEDTATYYCARGNWHYFDFWGQGTMVTVSSGGGGSGGGGSGGGGSGGGGSSYTLTQPPLLSVALGHKATITCSGERLSDKYVHWYQQKPGRAPVMVIYENDKRPSGIPDQFSGSNSGNIATLTISKAQAGYEADYYCQSWDSTNSAVFGSGTQLTVL

SEQ ID NO: 6188 - protein, 245 aa, synthetic construct
  source 1..245: note = Description of Artificial Sequence: Synthetic polypeptide
SYTLTQPPLLSVALGHKATITCSGERLSDKYVHWYQQKPGRAPVMVIYENDKRPSGIPDQFSGSNSGNIATLTISKAQAGYEADYYCQSWDSTNSAVFGSGTQLTVLGGGGSGGGGSGGGGSGGGGSQIQLQESGPGLVKPSQSLSLTCSVTGFSINTGGYHWNWIRQFPGKKLEWMGYIYSSGSTSYNPSLKSRISITRDTSKNQFFLQLNSVTTEDTATYYCARGNWHYFDFWGQGTMVTVSS

SEQ ID NO: 6189 - protein, 245 aa, synthetic construct
  source 1..245: note = Description of Artificial Sequence: Synthetic polypeptide
QIQLQESGPGLVKPSQSLSLTCSVTGFSINTGGYHWNWIRQFPGKKLEWMGYIYSSGTTRYNPSLKSRISITRDTSKNQFFLQLNSVTPEDTATYYCTRGNWHYFDYWGQGTLVAVSSGGGGSGGGGSGGGGSGGGGSSYTLTQPPSLSVAPGQKATIICSGENLSDKYVHWYQQKPGRAPVMVIYENEKRPSGIPDQFSGSNSGNIATLTISKAQPGSEADYYCHYWESINSVVFGSGTHLTVL

SEQ ID NO: 6190 - protein, 245 aa, synthetic construct
  source 1..245: note = Description of Artificial Sequence: Synthetic polypeptide
SYTLTQPPSLSVAPGQKATIICSGENLSDKYVHWYQQKPGRAPVMVIYENEKRPSGIPDQFSGSNSGNIATLTISKAQPGSEADYYCHYWESINSVVFGSGTHLTVLGGGGSGGGGSGGGGSGGGGSQIQLQESGPGLVKPSQSLSLTCSVTGFSINTGGYHWNWIRQFPGKKLEWMGYIYSSGTTRYNPSLKSRISITRDTSKNQFFLQLNSVTPEDTATYYCTRGNWHYFDYWGQGTLVAVSS

SEQ ID NO: 6191 - protein, 227 aa, synthetic construct
  source 1..227: note = Description of Artificial Sequence: Synthetic polypeptide
EVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 6192-7016 - skipped (825 entries)

SEQ ID NO: 7017 - protein, 114 aa, Homo sapiens
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 7018 - protein, 77 aa, synthetic construct
  source 1..77: note = Description of Artificial Sequence: Synthetic polypeptide
MAPRRARGCRTLGLPALLLLLLLRPPATRGITCPPPMSVEHADIWVKSYSLYSRERYICNSGFKRKAGTSSLTECVL

SEQ ID NO: 7019 - protein, 20 aa, synthetic construct
  source 1..20: note = Description of Artificial Sequence: Synthetic peptide
SGGSGGGGSGGGSGGGGSLQ

SEQ ID NO: 7020 - protein, 133 aa, Homo sapiens [sequence omitted]

SEQ ID NO: 7021 - protein, 157 aa, Homo sapiens
YFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 7022 - protein, 133 aa, Homo sapiens [sequence omitted]

SEQ ID NO: 7023 - protein, 138 aa, Homo sapiens
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRG

SEQ ID NO: 7024-7226 - skipped (203 entries)

SEQ ID NO: 7227 - protein, 133 aa, unidentified
  source 1..133: note = Description of Unknown: IL-2 cytokine sequence
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 7228 - protein, 133 aa, unidentified
  source 1..133: note = Description of Unknown: IL-2 cytokine sequence
APASSSTKKTQLQLEHLLLDLQMILNGINNYKNPKLTRMLTAKFAMPKKATELKHLQCLEEELKPLEEVLNGAQSKNFHLRPRDLISNINVIVLELKGSETTFMCEYADETATIVEFLNRWITFAQSIISTLT

SEQ ID NO: 7229 - protein, 518 aa, synthetic construct
  source 1..518: note = Description of Artificial Sequence: Synthetic polypeptide
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 7230 - protein, 340 aa, synthetic construct
  source 1..340: note = Description of Artificial Sequence: Synthetic polypeptide
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNGGGGSGGGGSGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 7231 - protein, 166 aa, synthetic construct
  source 1..166: note = Description of Artificial Sequence: Synthetic polypeptide
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 7232 - protein, 114 aa, synthetic construct
  source 1..114: note = Description of Artificial Sequence: Synthetic polypeptide
NWVNVISDLKKIEDLIQSMHIDATLYTESDVHPSCKVTAMKCFLLELQVISLASGDASIHDTVENLIILANNSLSSNGAVTESGCKECEELEEKNIKEFLQSFVHIVQMFINTS

SEQ ID NO: 7233 - protein, 238 aa, unidentified
  source 1..238: note = Description of Unknown: B7-6 sequence
DLKVEMMAGGTQITPLNDNVTIFCNIFYSQPLNITSMGITWFWKSLTFDKEVKVFEFFGDHQEAFRPGAIVSPWRLKSGDASLRLPGIQLEEAGEYRCEVVVTPLKAQGTVQLEVVASPASRLLLDQVGMKENEDKYMCESSGFYPEAINITWEKQTQKFPHPIEISEDVITGPTIKNMDGTFNVTSCLKLNSSQEDPGTVYQCVVRHASLHTPLRSNFTLTAARHSLSETEKTDNFS

SEQ ID NO: 7234 - protein, 284 aa, unidentified
  source 1..284: note = Description of Unknown: MICA sequence
EPHSLRYNLTVLSWDGSVQSGFLTEVHLDGQPFLRCDRQKCRAKPQGQWAEDVLGNKTWDRETRDLTGNGKDLRMTLAHIKDQKEGLHSLQEIRVCEIHEDNSTRSSQHFYYDGELFLSQNLETKEWTMPQSSRAQTLAMNVRNFLKEDAMKTKTHYHAMHADCLQELRRYLKSGVVLRRTVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHW

SEQ ID NO: 7235 - protein, 287 aa, unidentified
  source 1..287: note = Description of Unknown: MICB sequence
AEPHSLRYNLMVLSQDESVQSGFLAEGHLDGQPFLRYDRQKRRAKPQGQWAEDVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKVLVLQSQRTD

SEQ ID NO: 7236 - protein, 191 aa, unidentified
  source 1..191: note = Description of Unknown: ULBP1 sequence
GWVDTHCLCYDFIITPKSRPEPQWCEVQGLVDERPFLHYDCVNHKAKAFASLGKKVNVTKTWEEQTETLRDVVDFLKGQLLDIQVENLIPIEPLTLQARMSCEHEAHGHGRGSWQFLFNGQKFLLFDSNNRKWTALHPGAKKMTEKWEKNRDVTMFFQKISLGDCKMWLEEFLMYWEQMLDPTKPPSLAPG

SEQ ID NO: 7237 - protein, 329 aa, unidentified
  source 1..329: note = Description of Unknown: NECTIN2 sequence
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 7238 - protein, 323 aa, unidentified
  source 1..323: note = Description of Unknown: NECL5 sequence
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 7239 - protein, 330 aa, unidentified
  source 1..330: note = Description of Unknown: NECL2 sequence
QNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDH

SEQ ID NO: 7240 - protein, 155 aa, unidentified
  source 1..155: note = Description of Unknown: CD70 sequence
QRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 7241 - protein, 294 aa, unidentified
  source 1..294: note = Description of Unknown: L-selectin sequence
WTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQVIQCEPLSAPDLGIMNCSHPLASFSFTSACTFICSEGTELIGKKKTICESSGIWSNPSPICQKLDKSFSMIKEGDYN

SEQ ID NO: 7242 - protein, 243 aa, unidentified
  source 1..243: note = Description of Unknown: CD72 sequence
RYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTCCPSGWIMHQKSCFYISLTSKNWQESQKQCETLSSKLATFSEIYPQSHSYYFLNSLLPNGGSGNSYWTGLSSNKDWKLTDDTQRTRTYAQSSKCNKVHKTWSWWTLESESCRSSLPYICEMTAFRFPD

SEQ ID NO: 7243 - protein, 124 aa, unidentified
  source 1..124: note = Description of Unknown: CLEC2B sequence
KLTRDSQSLCPYDWIGFQNKCYYFSKEEGDWNSSKYNCSTQHADLTIIDNIEEMNFLRRYKCSSDHWIGLKMAKNRTGQWVDGATFTKSFGMRGSEGCAYLSDDGAATARCYTERKWICRKRIH

SEQ ID NO: 7244 - protein, 194 aa, unidentified
  source 1..194: note = Description of Unknown: CD48 sequence
QGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLARS

SEQ ID NO: 7245 - protein, 133 aa, unidentified
  source 1..133: note = Description of Unknown: OX40L sequence
QVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 7246 - protein, 149 aa, unidentified
  source 1..149: note = Description of Unknown: CD40L sequence
MQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 7247 - protein, 205 aa, unidentified
  source 1..205: note = Description of Unknown: 41BB sequence
ACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 7248 - protein, 455 aa, unidentified
  source 1..455: note = Description of Unknown: rHuPH20 sequence
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 7249 - protein, 5 aa, synthetic construct
  source 1..5: note = Description of Artificial Sequence: Synthetic peptide
GGGGS

SEQ ID NO: 7250 - protein, 10 aa, synthetic construct
  source 1..10: note = Description of Artificial Sequence: Synthetic peptide
GGGGSGGGGS

SEQ ID NO: 7251 - protein, 15 aa, synthetic construct
  source 1..15: note = Description of Artificial Sequence: Synthetic peptide
GGGGSGGGGSGGGGS

SEQ ID NO: 7252 - protein, 17 aa, synthetic construct
  source 1..17: note = Description of Artificial Sequence: Synthetic peptide
DVPSGPGGGGGSGGGGS

SEQ ID NO: 7253 - protein, 413 aa, unidentified
  source 1..413: note = Description of Unknown: HYAL1 sequence
FRGPLLPNRPFTTVWNANTQWCLERHGVDVDVSVFDVVANPGQTFRGPDMTIFYSSQGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 7254 - protein, 551 aa, unidentified
  source 1..551: note = Description of Unknown: collagenase molecule IV sequence
YNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 7255 - protein, 27 aa, synthetic construct
  source 1..27: note = Description of Artificial Sequence: Synthetic peptide
  VARIANT 2..26: note = SITE - This region may encompass 2-5 Glu Ala Ala Ala Lys repeating units
AEAAAKEAAAKEAAAKEAAAKEAAAKA

SEQ ID NO: 7256 - protein, 455 aa, unidentified; identical to SEQ ID NO: 7248
  source 1..455: note = Description of Unknown: hyaluronidase sequence

SEQ ID NO: 7257-7291 - skipped (35 entries)

SEQ ID NO: 7292 - protein, 32 aa, synthetic construct
  source 1..32: note = Description of Artificial Sequence: Synthetic polypeptide
GIPDQFSGSNSGNIATLTISKAQAGYEADYYC

SEQ ID NO: 7293 - protein, 10 aa, synthetic construct
  source 1..10: note = Description of Artificial Sequence: Synthetic peptide
QSWDSTNSAV

SEQ ID NO: 7294 - protein, 107 aa, synthetic construct
  source 1..107: note = Description of Artificial Sequence: Synthetic polypeptide
SYTLTQPPLLSVALGHKATITCSGERLSDKYVHWYQQKPGRAPVMVIYENDKRPSGIPDQFSGSNSGNIATLTISKAQAGYEADYYCQSWDSTNSAVFGSGTQLTVL

SEQ ID NO: 7295 - protein, 118 aa, synthetic construct
  source 1..118: note = Description of Artificial Sequence: Synthetic polypeptide
QIQLQESGPGLVKPSQSLSLSCSVTGFSINTGGYHWNWIRQFPGKKVEWMGYIYSSGTTKYNPSLKSRISITRDTSKNQFFLQLNSVTTEDTATYYCARGDWHYFDYWGQGTMVAVSS

SEQ ID NO: 7296 - protein, 107 aa, synthetic construct
  source 1..107: note = Description of Artificial Sequence: Synthetic polypeptide
SYTLTQPPLVSVALGQKATIICSGENLSDKYVHWYQQKPGRAPVMVIYENDKRPSGIPDQFSGSNSGNIATLTISKAQAGYEADYYCHCWDSTNSAVFGSGTHLTVL

SEQ ID NO: 7297 - protein, 118 aa, synthetic construct
  source 1..118: note = Description of Artificial Sequence: Synthetic polypeptide
QIQLQESGPGLVKPSQSLSLTCSVTGFSINTGGYHWNWIRQFPGKKLEWMGYIYSSGSTRYNPSLKSRFSITRDTSKNQFFLQLNSVTTEDTATYYCTRGNWHYFDYWGQGTLVAVSS

SEQ ID NO: 7298 - protein, 118 aa, synthetic construct
  source 1..118: note = Description of Artificial Sequence: Synthetic polypeptide
QIQLQESGPGLVKPSQSLSLSCSVTGFSITTTGYHWNWIRQFPGKKLEWMGYIYSSGSTSYNPSLKSRFSITRDTSKNQFFLQLNSVTTEDTATYYCARGDWHYFDYWGPGTMVTVSS

SEQ ID NO: 7299 - protein, 107 aa, synthetic construct
  source 1..107: note = Description of Artificial Sequence: Synthetic polypeptide
SFTLTQPPLVSVAVGQVATITCSGEKLSDKYVHWYQQKPGRAPVMVIYENDRRPSGIPDQFSGSNSGNIASLTISKAQAGDEADYFCQFWDSTNSAVFGGGTQLTVL

SEQ ID NO: 7300 - protein, 118 aa, synthetic construct
  source 1..118: note = Description of Artificial Sequence: Synthetic polypeptide
QIQLQESGPGLVKPSQTLSLTCTVSGFSITTTGYHWNWIRQHPGKGLEWIGYIYSSGSTSYNPSLKSLVTISRDTSKNQFSLKLSSVTAADTAVYYCARGDWHYFDYWGQGTMVTVSS

SEQ ID NO: 7301 - protein, 118 aa, synthetic construct
  source 1..118: note = Description of Artificial Sequence: Synthetic polypeptide
QIQLVESGGGLVKPGGSLRLSCAVSGFSITTTGYHWNWIRQAPGKGLEWVGYIYSSGSTSYNPSLKSRFTISRDTAKNSFYLQMNSLRAEDTAVYYCARGDWHYFDYWGQGTMVTVSS

SEQ ID NO: 7302 - protein, 118 aa, synthetic construct
  source 1..118: note = Description of Artificial Sequence: Synthetic polypeptide
EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSS

SEQ ID NO: 7303 - protein, 118 aa, synthetic construct
  source 1..118: note = Description of Artificial Sequence: Synthetic polypeptide
EIQLVESGGGLVQPGGSLRLSCAVSGFSITTTGYHWNWVRQAPGKGLEWVGYIYSSGSTSYNPSLKSRFTISRDTAKNSFYLQMNSLRAEDTAVYYCARGDWHYFDYWGQGTMVTVSS

SEQ ID NO: 7304 - protein, 118 aa, synthetic construct
  source 1..118: note = Description of Artificial Sequence: Synthetic polypeptide
QIQLVQSGAEVKKPGASVKVSCKVSGFSITTTGYHWNWVRQAPGQGLEWMGYIYSSGSTSYNPSLKSRVTMTRDTSTNTFYMELSSLRSEDTAVYYCARGDWHYFDYWGQGTMVTVSS

SEQ ID NO: 7305 - protein, 107 aa, synthetic construct
  source 1..107: note = Description of Artificial Sequence: Synthetic polypeptide
SSETTQPPSVSVSPGQTASITCSGEKLSDKYVHWYQQKPGQSPVMVIYENDRRPSGIPERFSGSNSGNTATLTISGTQAMDEADYFCQFWDSTNSAVFGGGTQLTVL

SEQ ID NO: 7306 - protein, 107 aa, synthetic construct
  source 1..107: note = Description of Artificial Sequence: Synthetic polypeptide
SSETTQPHSVSVATAQMARITCSGEKLSDKYVHWYQQKPGQDPVMVIYENDRRPSGIPERFSGSNPGNTATLTISRIEAGDEADYFCQFWDSTNSAVFGGGTQLTVL

SEQ ID NO: 7307 - protein, 107 aa, synthetic construct
  source 1..107: note = Description of Artificial Sequence: Synthetic polypeptide
QSVTTQPPSASGTPGQRVTISCSGEKLSDKYVHWYQQLPGTAPKMLIYENDRRPSGVPDRFSGSNSGNSASLAISGLRSEDEADYFCQFWDSTNSAVFGGGTQLTVL

SEQ ID NO: 7308 - protein, 107 aa, synthetic construct
  source 1..107: note = Description of Artificial Sequence: Synthetic polypeptide
QSVTTQPPSVSGAPGQRVTISCSGEKLSDKYVHWYQQLPGTAPKMLIYENDRRPSGVPDRFSGSNSGNSASLAITGLQAEDEADYFCQFWDSTNSAVFGGGTQLTVL

SEQ ID NO: 7309 - protein, 108 aa, synthetic construct
  source 1..108: note = Description of Artificial Sequence: Synthetic polypeptide
DSVTTQSPLSLPVTLGQPASISCSGEKLSDKYVHWYQQRPGQSPRMLIYENDRRPSGVPDRFSGSNSGNDATLKISRVEAEDVGVYFCQFWDSTNSAVFGGGTKVEIK

SEQ ID NO: 7310 - protein, 245 aa, synthetic construct
  source 1..245: note = Description of Artificial Sequence: Synthetic polypeptide
EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSSGGGGSGGGGSGGGGSGGGGSSSETTQPPSVSVSPGQTASITCSGEKLSDKYVHWYQQKPGQSPVMVIYENDRRPSGIPERFSGSNSGNTATLTISGTQAMDEADYFCQFWDSTNSAVFGGGTQLTVL

SEQ ID NO: 7311 - protein, 246 aa, synthetic construct
  source 1..246: note = Description of Artificial Sequence: Synthetic polypeptide
EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSSGGGGSGGGGSGGGGSGGGGSDSVTTQSPLSLPVTLGQPASISCSGEKLSDKYVHWYQQRPGQSPRMLIYENDRRPSGVPDRFSGSNSGNDATLKISRVEAEDVGVYFCQFWDSTNSAVFGGGTKVEIK

SEQ ID NO: 7312 - protein, 32 aa, synthetic construct
  source 1..32: note = Description of Artificial Sequence: Synthetic polypeptide
QIQLQESGPGLVKPSQSLSLSCSVTGFSINTG

SEQ ID NO: 7313 - protein, 5 aa, synthetic construct
  source 1..5: note = Description of Artificial Sequence: Synthetic peptide
GYHWN

SEQ ID NO: 7314 - protein, 14 aa, synthetic construct
  source 1..14: note = Description of Artificial Sequence: Synthetic peptide
WIRQFPGKKVEWMG

SEQ ID NO: 7315 - protein, 8 aa, synthetic construct
  source 1..8: note = Description of Artificial Sequence: Synthetic peptide
GDWHYFDY

SEQ ID NO: 7316 - protein, 11 aa, synthetic construct
  source 1..11: note = Description of Artificial Sequence: Synthetic peptide
WGQGTMVAVSS

SEQ ID NO: 7317 - protein, 32 aa, synthetic construct; identical to SEQ ID NO: 6003
  source 1..32: note = Description of Artificial Sequence: Synthetic polypeptide

SEQ ID NO: 7318 - protein, 16 aa, synthetic construct
  source 1..16: note = Description of Artificial Sequence: Synthetic peptide
YIYSSGSTRYNPSLKS

SEQ ID NO: 7319 - protein, 32 aa, synthetic construct
  source 1..32: note = Description of Artificial Sequence: Synthetic polypeptide
RFSITRDTSKNQFFLQLNSVTTEDTATYYCTR

SEQ ID NO: 7320 - protein, 22 aa, synthetic construct
  source 1..22: note = Description of Artificial Sequence: Synthetic peptide
SYTLTQPPLVSVALGQKATIIC

SEQ ID NO: 7321 - protein, 10 aa, synthetic construct
  source 1..10: note = Description of Artificial Sequence: Synthetic peptide
HCWDSTNSAV

SEQ ID NO: 7322 - protein, 32 aa, synthetic construct
  source 1..32: note = Description of Artificial Sequence: Synthetic polypeptide
QIQLQESGPGLVKPSQSLSLSCSVTGFSITTT

SEQ ID NO: 7323 - protein, 32 aa, synthetic construct
  source 1..32: note = Description of Artificial Sequence: Synthetic polypeptide
RFSITRDTSKNQFFLQLNSVTTEDTATYYCAR

SEQ ID NO: 7324 - protein, 11 aa, synthetic construct
  source 1..11: note = Description of Artificial Sequence: Synthetic peptide
WGPGTMVTVSS

SEQ ID NO: 7325 - protein, 22 aa, synthetic construct
  source 1..22: note = Description of Artificial Sequence: Synthetic peptide
SFTLTQPPLVSVAVGQVATITC

SEQ ID NO: 7326 - protein, 11 aa, synthetic construct
  source 1..11: note = Description of Artificial Sequence: Synthetic peptide
SGEKLSDKYVH

SEQ ID NO: 7327 - protein, 7 aa, synthetic construct
  source 1..7: note = Description of Artificial Sequence: Synthetic peptide
ENDRRPS

SEQ ID NO: 7328 - protein, 32 aa, synthetic construct
  source 1..32: note = Description of Artificial Sequence: Synthetic polypeptide
GIPDQFSGSNSGNIASLTISKAQAGDEADYFC

SEQ ID NO: 7329 - protein, 10 aa, synthetic construct
  source 1..10: note = Description of Artificial Sequence: Synthetic peptide
QFWDSTNSAV

SEQ ID NO: 7330 - protein, 32 aa, synthetic construct
  source 1..32: note = Description of Artificial Sequence: Synthetic polypeptide
QIQLQESGPGLVKPSQTLSLTCTVSGFSITTT

SEQ ID NO: 7331 - protein, 32 aa, synthetic construct
  source 1..32: note = Description of Artificial Sequence: Synthetic polypeptide
QIQLVESGGGLVKPGGSLRLSCAVSGFSITTT

SEQ ID NO: 7332 - protein, 32 aa, synthetic construct
  source 1..32: note = Description of Artificial Sequence: Synthetic polypeptide
EIQLLESGGGLVQPGGSLRLSCAVSGFSITTT

SEQ ID NO: 7333 - protein, 32 aa, synthetic construct
  source 1..32: note = Description of Artificial Sequence: Synthetic polypeptide
EIQLVESGGGLVQPGGSLRLSCAVSGFSITTT

SEQ ID NO: 7334 - protein, 32 aa, synthetic construct
  source 1..32: note = Description of Artificial Sequence: Synthetic polypeptide
QIQLVQSGAEVKKPGASVKVSCKVSGFSITTT

SEQ ID NO: 7335 - protein, 22 aa, synthetic construct
  source 1..22: note = Description of Artificial Sequence: Synthetic peptide
SSETTQPPSVSVSPGQTASITC

SEQ ID NO: 7336 - protein, 32 aa, synthetic construct
  source 1..32: note = Description of Artificial Sequence: Synthetic polypeptide
GIPERFSGSNSGNTATLTISGTQAMDEADYFC

SEQ ID NO: 7337 - protein, 32 aa, synthetic construct
  source 1..32: note = Description of Artificial Sequence: Synthetic polypeptide
GIPERFSGSNPGNTATLTISRIEAGDEADYFC

SEQ ID NO: 7338 - protein, 32 aa, synthetic construct
  source 1..32: note = Description of Artificial Sequence: Synthetic polypeptide
GVPDRFSGSNSGNSASLAISGLRSEDEADYFC

SEQ ID NO: 7339 - protein, 32 aa, synthetic construct
  source 1..32: note = Description of Artificial Sequence: Synthetic polypeptide
GVPDRFSGSNSGNSASLAITGLQAEDEADYFC

SEQ ID NO: 7340 - protein, 23 aa, synthetic construct
  source 1..23: note = Description of Artificial Sequence: Synthetic peptide
DSVTTQSPLSLPVTLGQPASISC

SEQ ID NO: 7341 - protein, 15 aa, synthetic construct
  source 1..15: note = Description of Artificial Sequence: Synthetic peptide
WYQQRPGQSPRMLIY

SEQ ID NO: 7342 - protein, 32 aa, synthetic construct
  source 1..32: note = Description of Artificial Sequence: Synthetic polypeptide
GVPDRFSGSNSGNDATLKISRVEAEDVGVYFC

SEQ ID NO: 7343 - protein, 124 aa, synthetic construct
  source 1..124: note = Description of Artificial Sequence: Synthetic polypeptide
QVQLVQSGAEVKKPGSSVKVSCKASGYTFTGYVMHWVRQAPGQGLEWMGFINPYNDDIQSNERFRGRVTITSDKSTTTAYMELSSLRSEDTAVYYCARGAGYNFDGAYRFFDFWGQGTTVTVSS

SEQ ID NO: 7344 - protein, 124 aa, synthetic construct
  source 1..124: note = Description of Artificial Sequence: Synthetic polypeptide
QVQLVQSGAEVKKPGASVKVSCKASGYTFTGYVMHWVRQAPGQGLEWMGFINPYNDDIQSNERFRGRVTMTSDKSITTAYMELSRLRSDDTAVYYCARGAGYNFDGAYRFFDFWGQGTTVTVSS

SEQ ID NO: 7345 - protein, 30 aa, synthetic construct; identical to SEQ ID NO: 215
  source 1..30: note = Description of Artificial Sequence: Synthetic polypeptide

SEQ ID NO: 7346 - protein, 5 aa, synthetic construct
  source 1..5: note = Description of Artificial Sequence: Synthetic peptide
GYVMH

SEQ ID NO: 7347 - protein, 11 aa, synthetic construct
  source 1..11: note = Description of Artificial Sequence: Synthetic peptide
WGQGTTVTVSS

SEQ ID NO: 7348 - protein, 30 aa, synthetic construct; identical to SEQ ID NO: 207
  source 1..30: note = Description of Artificial Sequence: Synthetic polypeptide

SEQ ID NO: 7349 - protein, 32 aa, synthetic construct
  source 1..32: note = Description of Artificial Sequence: Synthetic polypeptide
RVTMTSDKSITTAYMELSRLRSDDTAVYYCAR

SEQ ID NO: 7350 - protein, 124 aa, synthetic construct
  source 1..124: note = Description of Artificial Sequence: Synthetic polypeptide
QVQLVQSGAEVKKPGSSVKVSCKASGYTFSGYAISWVRQAPGQGLEWMGFINPYNDDIQSNERFRGRVTITSDKSTTTAYMELSSLRSEDTAVYYCARGAGYNFDGAYRFFDFWGQGTLVTVSS

SEQ ID NO: 7351 - protein, 124 aa, synthetic construct
  source 1..124: note = Description of Artificial Sequence: Synthetic polypeptide
QVQLVQSGAEVKKPGSSVKVSCKASGYTFTGYVMHWVRQAPGQGLEWMGFIIPIFGTANYAQKFQGRVTITSDKSTTTAYMELSSLRSEDTAVYYCARGAGYNFDGAYRFFDFWGQGTLVTVSS

SEQ ID NO: 7352 - protein, 124 aa, synthetic construct
  source 1..124: note = Description of Artificial Sequence: Synthetic polypeptide
QVQLVQSGAEVKKPGSSVKVSCKASGYTFSGYAISWVRQAPGQGLEWMGFIIPIFGTANYAQKFQGRVTITSDKSTTTAYMELSSLRSEDTAVYYCARGAGYNFDGAYRFFDFWGQGTLVTVSS

SEQ ID NO: 7353 - protein, 30 aa, synthetic construct
  source 1..30: note = Description of Artificial Sequence: Synthetic polypeptide
QVQLVQSGAEVKKPGSSVKVSCKASGYTFS

SEQ ID NO: 7354 - protein, 5 aa, synthetic construct
  source 1..5: note = Description of Artificial Sequence: Synthetic peptide
GYAIS

SEQ ID NO: 7355 - protein, 17 aa, synthetic construct
  source 1..17: note = Description of Artificial Sequence: Synthetic peptide
FIIPIFGTANYAQKFQG

SEQ ID NO: 7356 - skipped

SEQ ID NO: 7357 - protein, 111 aa, synthetic construct
  source 1..111: note = Description of Artificial Sequence: Synthetic polypeptide
DVVMTQSPLSLPVTLGQPASISCRSSQSLVYSDGNTYHWYQQRPGQSPRLLIYRVSNRFPGVPDRFSGSGSGTDFTLKISRVEAEDVGVYFCSQSTHVPYTFGGGTKVEIK

SEQ ID NO: 7358 - protein, 112 aa, synthetic construct
  source 1..112: note = Description of Artificial Sequence: Synthetic polypeptide
DVVMTQSPLSLPVTLGQPASISCRSSQRLVHSNGNTYLHWYQQRPGQSPRLLIYKVSNRDSGVPDRFSGSGSGTDFTLKISRVEAEDVGVYFCSQSTHVPYTFGGGTKVEIK

SEQ ID NO: 7359 - protein, 112 aa, synthetic construct
  source 1..112: note = Description of Artificial Sequence: Synthetic polypeptide
DVVMTQSPLSLPVTLGQPASISCRSSQRLVHSNGNTYLHWYQQRPGQSPRLLIYRVSNRFPGVPDRFSGSGSGTDFTLKISRVEAEDVGVYFCMQSTHWPYTFGGGTKVEIK

SEQ ID NO: 7360 - protein, 111 aa, synthetic construct
  source 1..111: note = Description of Artificial Sequence: Synthetic polypeptide
DVVMTQSPLSLPVTLGQPASISCRSSQSLVYSDGNTYHWYQQRPGQSPRLLIYKVSNRDSGVPDRFSGSGSGTDFTLKISRVEAEDVGVYFCMQSTHWPYTFGGGTKVEIK

SEQ ID NO: 7361-7366 - skipped (6 entries)

SEQ ID NO: 7367 - protein, 15 aa, synthetic construct
  source 1..15: note = Description of Artificial Sequence: Synthetic peptide
RSSQSLVYSDGNTYH

SEQ ID NO: 7368 - protein, 7 aa, synthetic construct
  source 1..7: note = Description of Artificial Sequence: Synthetic peptide
KVSNRDS

SEQ ID NO: 7369 - protein, 9 aa, synthetic construct
  source 1..9: note = Description of Artificial Sequence: Synthetic peptide
MQSTHWPYT

SEQ ID NO: 7370 - protein, 30 aa, synthetic construct; identical to SEQ ID NO: 203
  source 1..30: note = Description of Artificial Sequence: Synthetic polypeptide

SEQ ID NO: 7371 - protein, 32 aa, synthetic construct; identical to SEQ ID NO: 6014
  source 1..32: note = Description of Artificial Sequence: Synthetic polypeptide

SEQ ID NO: 7372 - protein, 32 aa, synthetic construct; identical to SEQ ID NO: 6018
  source 1..32: note = Description of Artificial Sequence: Synthetic polypeptide

SEQ ID NO: 7373 - protein, 32 aa, synthetic construct; identical to SEQ ID NO: 6022
  source 1..32: note = Description of Artificial Sequence: Synthetic polypeptide

SEQ ID NO: 7374 - protein, 32 aa, synthetic construct; identical to SEQ ID NO: 6026
  source 1..32: note = Description of Artificial Sequence: Synthetic polypeptide

SEQ ID NO: 7375 - protein, 32 aa, synthetic construct; identical to SEQ ID NO: 6030
  source 1..32: note = Description of Artificial Sequence: Synthetic polypeptide

SEQ ID NO: 7376 - protein, 32 aa, synthetic construct; identical to SEQ ID NO: 6035
  source 1..32: note = Description of Artificial Sequence: Synthetic polypeptide

SEQ ID NO: 7377 - protein, 32 aa, synthetic construct; identical to SEQ ID NO: 6051
  source 1..32: note = Description of Artificial Sequence: Synthetic polypeptide

SEQ ID NO: 7378 - protein, 32 aa, synthetic construct; identical to SEQ ID NO: 6059
  source 1..32: note = Description of Artificial Sequence: Synthetic polypeptide

SEQ ID NO: 7379 - protein, 454 aa, synthetic construct
  source 1..454: note = Description of Artificial Sequence: Synthetic polypeptide
QVQLVQSGAEVKKPGSSVKVSCKASGYTFTGYVMHWVRQAPGQGLEWMGFINPYNDDIQSNERFRGRVTITSDKSTTTAYMELSSLRSEDTAVYYCARGAGYNFDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7380 - protein, 219 aa, synthetic construct
  source 1..219: note = Description of Artificial Sequence: Synthetic polypeptide
DVVMTQSPLSLPVTLGQPASISCRSSQRLVHSNGNTYLHWYQQRPGQSPRLLIYRVSNRFPGVPDRFSGSGSGTDFTLKISRVEAEDVGVYFCSQSTHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7381 - protein, 472 aa, synthetic construct
  source 1..472: note = Description of Artificial Sequence: Synthetic polypeptide
QIQLQESGPGLVKPSQSLSLSCSVTGFSITTTGYHWNWIRQFPGKKLEWMGYIYSSGSTSYNPSLKSRFSITRDTSKNQFFLQLNSVTTEDTATYYCARGDWHYFDYWGPGTMVTVSSGGGGSGGGGSGGGGSGGGGSSFTLTQPPLVSVAVGQVATITCSGEKLSDKYVHWYQQKPGRAPVMVIYENDRRPSGIPDQFSGSNSGNIASLTISKAQAGDEADYFCQFWDSTNSAVFGGGTQLTVLDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 7382 - protein, 454 aa, synthetic construct
  source 1..454: note = Description of Artificial Sequence: Synthetic polypeptide
QVQLVQSGAEVKKPGSSVKVSCKASGYTFTGYVMHWVRQAPGQGLEWMGFIIPIFGTANYAQKFQGRVTITSDKSTTTAYMELSSLRSEDTAVYYCARGAGYNFDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7383 - protein, 473 aa, synthetic construct
  source 1..473: note = Description of Artificial Sequence: Synthetic polypeptide
EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSSGGGGSGGGGSGGGGSGGGGSDSVTTQSPLSLPVTLGQPASISCSGEKLSDKYVHWYQQRPGQSPRMLIYENDRRPSGVPDRFSGSNSGNDATLKISRVEAEDVGVYFCQFWDSTNSAVFGGGTKVEIKDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 7384 - protein, 472 aa, synthetic construct
  source 1..472: note = Description of Artificial Sequence: Synthetic polypeptide
EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSSGGGGSGGGGSGGGGSGGGGSSSETTQPPSVSVSPGQTASITCSGEKLSDKYVHWYQQKPGQSPVMVIYENDRRPSGIPERFSGSNSGNTATLTISGTQAMDEADYFCQFWDSTNSAVFGGGTQLTVLDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 7385 - protein, 16 aa, synthetic construct
  source 1..16: note = Description of Artificial Sequence: Synthetic peptide
YIYSSGTTKYNPSLKS

SEQ ID NO: 7386-7392 - skipped (7 entries)

SEQ ID NO: 7393 - protein, 30 aa, synthetic construct
  source 1..30: note = Description of Artificial Sequence: Synthetic polypeptide
QVQLVQSGAEVKKPGASVKVSCKASGYTFP

SEQ ID NO: 7394 - protein, 5 aa, synthetic construct
  source 1..5: note = Description of Artificial Sequence: Synthetic peptide
GFVMH

SEQ ID NO: 7395 - skipped

SEQ ID NO: 7396 - protein, 15 aa, synthetic construct
  source 1..15: note = Description of Artificial Sequence: Synthetic peptide
GNGMWFDGAYRFFDF

SEQ ID NO: 7397 - protein, 30 aa, synthetic construct
  source 1..30: note = Description of Artificial Sequence: Synthetic polypeptide
QVQLVQSGAEVKKPGASVKVSCKASGYPFH

SEQ ID NO: 7398 - protein, 15 aa, synthetic construct
  source 1..15: note = Description of Artificial Sequence: Synthetic peptide
GNGKNFDGAYRFFDF

SEQ ID NO: 7399 - protein, 30 aa, synthetic construct
  source 1..30: note = Description of Artificial Sequence: Synthetic polypeptide
QVQLVQSGAEVKKPGASVKVSCKASGYTYP

SEQ ID NO: 7400 - protein, 15 aa, synthetic construct
  source 1..15: note = Description of Artificial Sequence: Synthetic peptide
GNGKWFDGAYRFFDF

SEQ ID NO: 7401 - protein, 5 aa, synthetic construct
  source 1..5: note = Description of Artificial Sequence: Synthetic peptide
GYHMH

SEQ ID NO: 7402 - protein, 30 aa, synthetic construct
  source 1..30: note = Description of Artificial Sequence: Synthetic polypeptide
QVQLVQSGAEVKKPGASVKVSCKASNQNFH

SEQ ID NO: 7403 - protein, 15 aa, synthetic construct
  source 1..15: note = Description of Artificial Sequence: Synthetic peptide
GNGKWGDGAYRFFDF

SEQ ID NO: 7404 - protein, 30 aa, synthetic construct
  source 1..30: note = Description of Artificial Sequence: Synthetic polypeptide
QVQLVQSGAEVKKPGASVKVSCKASSQNFH

SEQ ID NO: 7405 - protein, 5 aa, synthetic construct
  source 1..5: note = Description of Artificial Sequence: Synthetic peptide
GFYMH

SEQ ID NO: 7406 - protein, 30 aa, synthetic construct
  source 1..30: note = Description of Artificial Sequence: Synthetic polypeptide
QVQLVQSGAEVKKPGASVKVSCKASYQDFH

SEQ ID NO: 7407 - protein, 5 aa, synthetic construct
  source 1..5: note = Description of Artificial Sequence: Synthetic peptide
GYKMH

SEQ ID NO: 7408 - protein, 30 aa, synthetic construct
  source 1..30: note = Description of Artificial Sequence: Synthetic polypeptide
QVQLVQSGAEVKKPGASVKVSCKASGYNFH

SEQ ID NO: 7409 - protein, 16 aa, synthetic construct
  source 1..16: note = Description of Artificial Sequence: Synthetic peptide
RSSQNLVHSNGRTYLH

SEQ ID NO: 7410 - protein, 16 aa, synthetic construct
  source 1..16: note = Description of Artificial Sequence: Synthetic peptide
RSSQNLVHSNGRTYLQ

SEQ ID NO: 7411 - protein, 124 aa, synthetic construct
  source 1..124: note = Description of Artificial Sequence: Synthetic polypeptide
QVQLVQSGAEVKKPGASVKVSCKASGYTFPGFVMHWVRQAPGQGLEWMGFINPYNDDIQSNERFRGRVTMTSDKSTTTAYMELSSLRSEDTAVYYCARGNGMWFDGAYRFFDFWGQGTLVTVSS

SEQ ID NO: 7412 - protein, 124 aa, synthetic construct
  source 1..124: note = Description of Artificial Sequence: Synthetic polypeptide
QVQLVQSGAEVKKPGASVKVSCKASGYPFHGYVMHWVRQAPGQGLEWMGFINPYNDDIQSNERFRGRVTMTSDKSTTTAYMELSSLRSEDTAVYYCARGNGKNFDGAYRFFDFWGQGTLVTVSS

SEQ ID NO: 7413 - protein, 124 aa, synthetic construct
  source 1..124: note = Description of Artificial Sequence: Synthetic polypeptide
QVQLVQSGAEVKKPGASVKVSCKASGYTYPGYVMHWVRQAPGQGLEWMGFINPYNDDIQSNERFRGRVTMTSDKSTTTAYMELSSLRSEDTAVYYCARGNGKWFDGAYRFFDFWGQGTLVTVSS

SEQ ID NO: 7414 - protein, 124 aa, synthetic construct
  source 1..124: note = Description of Artificial Sequence: Synthetic polypeptide
QVQLVQSGAEVKKPGASVKVSCKASNQNFHGYHMHWVRQAPGQGLEWMGFINPYNDDIQSNERFRGRVTMTSDKSTTTAYMELSSLRSEDTAVYYCARGNGKWGDGAYRFFDFWGQGTLVTVSS

SEQ ID NO: 7415 - protein, 124 aa, synthetic construct
  source 1..124: note = Description of Artificial Sequence: Synthetic polypeptide
QVQLVQSGAEVKKPGASVKVSCKASSQNFHGFYMHWVRQAPGQGLEWMGFINPYNDDIQSNERFRGRVTMTSDKSTTTAYMELSSLRSEDTAVYYCARGNGKWGDGAYRFFDFWGQGTLVTVSS

SEQ ID NO: 7416 - protein, 124 aa, synthetic construct
  source 1..124: note = Description of Artificial Sequence: Synthetic polypeptide
QVQLVQSGAEVKKPGASVKVSCKASYQDFHGYKMHWVRQAPGQGLEWMGFINPYNDDIQSNERFRGRVTMTSDKSTTTAYMELSSLRSEDTAVYYCARGNGKWGDGAYRFFDFWGQGTLVTVSS

SEQ ID NO: 7417 - protein, 124 aa, synthetic construct
  source 1..124: note = Description of Artificial Sequence: Synthetic polypeptide
QVQLVQSGAEVKKPGASVKVSCKASGYNFHGFYMHWVRQAPGQGLEWMGFINPYNDDIQSNERFRGRVTMTSDKSTTTAYMELSSLRSEDTAVYYCARGNGKWGDGAYRFFDFWGQGTLVTVSS

SEQ ID NO: 7418 - protein, 112 aa, synthetic construct
  source 1..112: note = Description of Artificial Sequence: Synthetic polypeptide
DVVMTQSPLSLPVTPGEPASISCRSSQNLVHSNGRTYLHWYLQKPGQSPQLLIYRVSNRFPGVPDRFSGSGSGTDFTLKISRVEAEDVGVYFCSQSTHVPYTFGGGTKVEIK

SEQ ID NO: 7419 - protein, 112 aa, synthetic construct
  source 1..112: note = Description of Artificial Sequence: Synthetic polypeptide
DVVMTQSPLSLPVTPGEPASISCRSSQNLVHSNGRTYLQWYLQKPGQSPQLLIYRVSNRFPGVPDRFSGSGSGTDFTLKISRVEAEDVGVYFCSQSTHVPYTFGGGTKVEIK

SEQ ID NO: 7420 - protein, 124 aa, synthetic construct
  source 1..124: note = Description of Artificial Sequence: Synthetic polypeptide
QVQLVQSGAEVKKPGASVKVSCKASTSGFHGYPMHWVRQAPGQGLEWMGFINPYNDDIQSNERFRGRVTMTSDKSTTTAYMELSSLRSEDTAVYYCARGNGKWGDGAYRFFDFWGQGTLVTVSS

SEQ ID NO: 7421 - protein, 30 aa, synthetic construct
  source 1..30: note = Description of Artificial Sequence: Synthetic polypeptide
QVQLVQSGAEVKKPGASVKVSCKASTSGFH

SEQ ID NO: 7422 - protein, 5 aa, synthetic construct
  source 1..5: note = Description of Artificial Sequence: Synthetic peptide
GYPMH

SEQ ID NO: 7423 - protein, 124 aa, synthetic construct
  source 1..124: note = Description of Artificial Sequence: Synthetic polypeptide
QVQLVQSGAEVKKPGASVKVSCKASPRGFHGYHMHWVRQAPGQGLEWMGFINPYNDDIQSNERFRGRVTMTSDKSTTTAYMELSSLRSEDTAVYYCARGNGKWGDGAYRFFDFWGQGTLVTVSS

SEQ ID NO: 7424 - protein, 30 aa, synthetic construct
  source 1..30: note = Description of Artificial Sequence: Synthetic polypeptide
QVQLVQSGAEVKKPGASVKVSCKASPRGFH

SEQ ID NO: 7425 - protein, 124 aa, synthetic construct
  source 1..124: note = Description of Artificial Sequence: Synthetic polypeptide
QVQLVQSGAEVKKPGASVKVSCKASFQDFHGYAMHWVRQAPGQGLEWMGFINPYNDDIQSNERFRGRVTMTSDKSTTTAYMELSSLRSEDTAVYYCARGNGKWGDGAYRFFDFWGQGTLVTVSS

SEQ ID NO: 7426 - protein, 30 aa, synthetic construct
  source 1..30: note = Description of Artificial Sequence: Synthetic polypeptide
QVQLVQSGAEVKKPGASVKVSCKASFQDFH

SEQ ID NO: 7427 - protein, 5 aa, synthetic construct
  source 1..5: note = Description of Artificial Sequence: Synthetic peptide
GYAMH

SEQ ID NO: 7428 - protein, 124 aa, synthetic construct
  source 1..124: note = Description of Artificial Sequence: Synthetic polypeptide
QVQLVQSGAEVKKPGASVKVSCKASSKDFHGFAMHWVRQAPGQGLEWMGFINPYNDDIQSNERFRGRVTMTSDKSTTTAYMELSSLRSEDTAVYYCARGNGKWGDGAYRFFDFWGQGTLVTVSS

SEQ ID NO: 7429 - protein, 30 aa, synthetic construct
  source 1..30: note = Description of Artificial Sequence: Synthetic polypeptide
QVQLVQSGAEVKKPGASVKVSCKASSKDFH

SEQ ID NO: 7430 - protein, 5 aa, synthetic construct
  source 1..5: note = Description of Artificial Sequence: Synthetic peptide
GFAMH

SEQ ID NO: 7431 - protein, 124 aa, synthetic construct
  source 1..124: note = Description of Artificial Sequence: Synthetic polypeptide
QVQLVQSGAEVKKPGASVKVSCKASPKGFHGYHMHWVRQAPGQGLEWMGFINPYNDDIQSNERFRGRVTMTSDKSTTTAYMELSSLRSEDTAVYYCARGNGKWGDGAYRFFDFWGQGTLVTVSS

SEQ ID NO: 7432 - protein, 30 aa, synthetic construct
  source 1..30: note = Description of Artificial Sequence: Synthetic polypeptide
QVQLVQSGAEVKKPGASVKVSCKASPKGFH

SEQ ID NO: 7433 - protein, 256 aa, synthetic construct
  source 1..256: note = Description of Artificial Sequence: Synthetic polypeptide
QVQLVQSGAEVKKPGASVKVSCKASTSGFHGYPMHWVRQAPGQGLEWMGFINPYNDDIQSNERFRGRVTMTSDKSTTTAYMELSSLRSEDTAVYYCARGNGKWGDGAYRFFDFWGQGTLVTVSSGGGGSGGGGSGGGGSGGGGSDVVMTQSPLSLPVTPGEPASISCRSSQNLVHSNGRTYLQWYLQKPGQSPQLLIYRVSNRFPGVPDRFSGSGSGTDFTLKISRVEAEDVGVYFCSQSTHVPYTFGGGTKVEIK

SEQ ID NO: 7434 - protein, 256 aa, synthetic construct
  source 1..256: note = Description of Artificial Sequence: Synthetic polypeptide
QVQLVQSGAEVKKPGASVKVSCKASPRGFHGYHMHWVRQAPGQGLEWMGFINPYNDDIQSNERFRGRVTMTSDKSTTTAYMELSSLRSEDTAVYYCARGNGKWGDGAYRFFDFWGQGTLVTVSSGGGGSGGGGSGGGGSGGGGSDVVMTQSPLSLPVTPGEPASISCRSSQNLVHSNGRTYLQWYLQKPGQSPQLLIYRVSNRFPGVPDRFSGSGSGTDFTLKISRVEAEDVGVYFCSQSTHVPYTFGGGTKVEIK

SEQ ID NO: 7435 - protein, 256 aa, synthetic construct
  source 1..256: note = Description of Artificial Sequence: Synthetic polypeptide
QVQLVQSGAEVKKPGASVKVSCKASFQDFHGYAMHWVRQAPGQGLEWMGFINPYNDDIQSNERFRGRVTMTSDKSTTTAYMELSSLRSEDTAVYYCARGNGKWGDGAYRFFDFWGQGTLVTVSSGGGGSGGGGSGGGGSGGGGSDVVMTQSPLSLPVTPGEPASISCRSSQNLVHSNGRTYLQWYLQKPGQSPQLLIYRVSNRFPGVPDRFSGSGSGTDFTLKISRVEAEDVGVYFCSQSTHVPYTFGGGTKVEIK

SEQ ID NO: 7436 - protein, 256 aa, synthetic construct
  source 1..256: note = Description of Artificial Sequence: Synthetic polypeptide
QVQLVQSGAEVKKPGASVKVSCKASSKDFHGFAMHWVRQAPGQGLEWMGFINPYNDDIQSNERFRGRVTMTSDKSTTTAYMELSSLRSEDTAVYYCARGNGKWGDGAYRFFDFWGQGTLVTVSSGGGGSGGGGSGGGGSGGGGSDVVMTQSPLSLPVTPGEPASISCRSSQNLVHSNGRTYLQWYLQKPGQSPQLLIYRVSNRFPGVPDRFSGSGSGTDFTLKISRVEAEDVGVYFCSQSTHVPYTFGGGTKVEIK

SEQ ID NO: 7437 - protein, 256 aa, synthetic construct
  source 1..256: note = Description of Artificial Sequence: Synthetic polypeptide
QVQLVQSGAEVKKPGASVKVSCKASPKGFHGYHMHWVRQAPGQGLEWMGFINPYNDDIQSNERFRGRVTMTSDKSTTTAYMELSSLRSEDTAVYYCARGNGKWGDGAYRFFDFWGQGTLVTVSSGGGGSGGGGSGGGGSGGGGSDVVMTQSPLSLPVTPGEPASISCRSSQNLVHSNGRTYLQWYLQKPGQSPQLLIYRVSNRFPGVPDRFSGSGSGTDFTLKISRVEAEDVGVYFCSQSTHVPYTFGGGTKVEIK

SEQ ID NO: 7438 - protein, 454 aa, synthetic construct
  source 1..454: note = Description of Artificial Sequence: Synthetic polypeptide
QVQLVQSGAEVKKPGASVKVSCKASTSGFHGYPMHWVRQAPGQGLEWMGFINPYNDDIQSNERFRGRVTMTSDKSTTTAYMELSSLRSEDTAVYYCARGNGKWGDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7439 - protein, 219 aa, synthetic construct
  source 1..219: note = Description of Artificial Sequence: Synthetic polypeptide
DVVMTQSPLSLPVTPGEPASISCRSSQNLVHSNGRTYLQWYLQKPGQSPQLLIYRVSNRFPGVPDRFSGSGSGTDFTLKISRVEAEDVGVYFCSQSTHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7440 - protein, 454 aa, synthetic construct
  source 1..454: note = Description of Artificial Sequence: Synthetic polypeptide
QVQLVQSGAEVKKPGASVKVSCKASPRGFHGYHMHWVRQAPGQGLEWMGFINPYNDDIQSNERFRGRVTMTSDKSTTTAYMELSSLRSEDTAVYYCARGNGKWGDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7441 - skipped

SEQ ID NO: 7442 - protein, 15 aa, synthetic construct
  source 1..15: note = Description of Artificial Sequence: Synthetic peptide
  VARIANT 4: note = MOD_RES - Lys or Met
  VARIANT 5: note = MOD_RES - Trp or Asn
  VARIANT 6: note = MOD_RES - Gly or Phe
GNGXXXDGAYRFFDF

SEQ ID NO: 7443 - protein, 16 aa, synthetic construct
  source 1..16: note = Description of Artificial Sequence: Synthetic peptide
  VARIANT 16: note = MOD_RES - Gln or His
RSSQNLVHSNGRTYLX

SEQ ID NO: 7444 - protein, 20 aa, synthetic construct
  source 1..20: note = Description of Artificial Sequence: Synthetic peptide
METDTLLLWVLLLWVPGSTG

SEQ ID NO: 7445-8000 - skipped (556 entries)

SEQ ID NO: 8001 - protein, 454 aa, synthetic construct
  source 1..454: note = Description of Artificial Sequence: Synthetic polypeptide
QVQLVQSGAEVKKPGSSVKVSCKASPRGFYGYHMHWVRQAPGQGLEWMGFINPYTNDIQYNERFRGRVTITSDESTTTAYMELSSLRSEDTAVYYCAMGNGKWGDGAYRFFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8002 - protein, 219 aa, synthetic construct
  source 1..219: note = Description of Artificial Sequence: Synthetic polypeptide
DVVMTQSPLSLPVTLGQPASISCRSSENLVHSNGRTYLQWYQQRPGQSPRLLIYRVSNRFPGVPDRFSGSGSGTDFTLKISRVEAEDVGVYFCSQSSLEPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8003 - protein, 473 aa, synthetic construct; identical to SEQ ID NO: 7383
  source 1..473: note = Description of Artificial Sequence: Synthetic polypeptide

SEQ ID NO: 8004 - protein, 454 aa, synthetic construct
  source 1..454: note = Description of Artificial Sequence: Synthetic polypeptide
QVQLVQSGAEVKKPGSSVKVSCKASPRGFYGYHMHWVRQAPGQGLEWMGFINPYNNHIQYNERFRGRVTITSDESTTTAYMELSSLRSEDTAVYYCALGNGKWGDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8005 - protein, 219 aa, synthetic construct
  source 1..219: note = Description of Artificial Sequence: Synthetic polypeptide
DVVMTQSPLSLPVTLGQPASISCRSSKNLVHSNGRTYLQWYQQRPGQSPRLLIYRVSNRFPGVPDRFSGSGSGTDFTLKISRVEAEDVGVYFCSQSTREPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8006 - protein, 472 aa, synthetic construct; identical to SEQ ID NO: 7384
  source 1..472: note = Description of Artificial Sequence: Synthetic polypeptide

SEQ ID NO: 8007 - protein, 454 aa, synthetic construct
  source 1..454: note = Description of Artificial Sequence: Synthetic polypeptide
QVQLVQSGAEVKKPGSSVKVSCKASPRGFYGYHMHWVRQAPGQGLEWMGFINPYNNHIQYNERFRGRVTITSDESTTTAYMELSSLRSEDTAVYYCALGEGKWGDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8008 - protein, 219 aa, synthetic construct; identical to SEQ ID NO: 8005
  source 1..219: note = Description of Artificial Sequence: Synthetic polypeptide

SEQ ID NO: 8009 - protein, 454 aa, synthetic construct
  source 1..454: note = Description of Artificial Sequence: Synthetic polypeptide
QVQLVQSGAEVKKPGSSVKVSCKASPRGFYGYHMHWVRQAPGQGLEWMGFINPYNNHIQYNERFRGRVTITSDESTTTAYMELSSLRSEDTAVYYCALGAGKWGDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8010 - protein, 219 aa, synthetic construct; identical to SEQ ID NO: 8005
  source 1..219: note = Description of Artificial Sequence: Synthetic polypeptide

SEQ ID NO: 8011 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYTNDIQYNERFRGRVTITSDESTTTAYMELSSLRSEDTAVYYCAMGNGKWGDGAYRFFDLWGQGTLVTVSS

SEQ ID NO: 8012 - protein, 112 aa, synthetic construct
  source 1..112: note = Description of Artificial Sequence: Synthetic polypeptide
DVVMTQSPLSLPVTLGQPASISCRSSENLVHSNGRTYLQWYQQRPGQSPRLLIYRVSNRFPGVPDRFSGSGSGTDFTLKISRVEAEDVGVYFCSQSSLEPYTFGGGTKVEIK

SEQ ID NO: 8013 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYNNHIQYNERFRGRVTITSDESTTTAYMELSSLRSEDTAVYYCALGNGKWGDGAYRFFDFWGQGTLVTVSS

SEQ ID NO: 8014 - protein, 112 aa, synthetic construct
  source 1..112: note = Description of Artificial Sequence: Synthetic polypeptide
DVVMTQSPLSLPVTLGQPASISCRSSKNLVHSNGRTYLQWYQQRPGQSPRLLIYRVSNRFPGVPDRFSGSGSGTDFTLKISRVEAEDVGVYFCSQSTREPYTFGGGTKVEIK

SEQ ID NO: 8015-8019 - skipped (5 entries)

SEQ ID NO: 8020 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYNNHIQYNERFRGRVTITSDESTTTAYMELSSLRSEDTAVYYCALGEGKWGDGAYRFFDFWGQGTLVTVSS

SEQ ID NO: 8021 - protein, 112 aa, synthetic construct; identical to SEQ ID NO: 8014
  source 1..112: note = Description of Artificial Sequence: Synthetic polypeptide

SEQ ID NO: 8022 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYNNHIQYNERFRGRVTITSDESTTTAYMELSSLRSEDTAVYYCALGAGKWGDGAYRFFDFWGQGTLVTVSS

SEQ ID NO: 8023 - protein, 112 aa, synthetic construct; identical to SEQ ID NO: 8014
  source 1..112: note = Description of Artificial Sequence: Synthetic polypeptide

SEQ ID NO: 8024 - protein, 124 aa, synthetic construct
  source 1..124: note = Description of Artificial Sequence: Synthetic polypeptide
QVQLVQSGAEVKKPGASVKVSCKASGYTFTGYVMHWVRQAPGQGLEWMGFINPYNDDIQSNERFRGRVTMTRDTSISTAYMELSRLRSDDTAVYYCARGAGYNFDGAYRFFDFWGQGTMVTVSS

SEQ ID NO: 8025 - protein, 112 aa, synthetic construct
  source 1..112: note = Description of Artificial Sequence: Synthetic polypeptide
DIVMTQSPLSLPVTPGEPASISCRSSQRLVHSNGNTYLHWYLQKPGQSPRLLIYRVSNRFPGVPDRFSGSGSGTDFTLKISRVEAEDVGVYYCSQSTHVPYTFGQGTKLEIK

SEQ ID NO: 8026-8029 - skipped (4 entries)

SEQ ID NO: 8030 - protein, 118 aa, synthetic construct; identical to SEQ ID NO: 7302
  source 1..118: note = Description of Artificial Sequence: Synthetic polypeptide

SEQ ID NO: 8031 - protein, 108 aa, synthetic construct; identical to SEQ ID NO: 7309
  source 1..108: note = Description of Artificial Sequence: Synthetic polypeptide

SEQ ID NO: 8032-8040 - skipped (9 entries)

SEQ ID NO: 8041 - protein, 7 aa, synthetic construct
  source 1..7: note = Description of Artificial Sequence: Synthetic peptide
PRGFYGY

SEQ ID NO: 8042 - protein, 19 aa, synthetic construct
  source 1..19: note = Description of Artificial Sequence: Synthetic peptide
MGFINPYTNDIQYNERFRG

SEQ ID NO: 8043 - protein, 15 aa, synthetic construct
  source 1..15: note = Description of Artificial Sequence: Synthetic peptide
GNGKWGDGAYRFFDL

SEQ ID NO: 8044 - protein, 17 aa, synthetic construct
  source 1..17: note = Description of Artificial Sequence: Synthetic peptide
FINPYNNHIQYNERFRG

SEQ ID NO: 8045 - protein, 15 aa, synthetic construct
  source 1..15: note = Description of Artificial Sequence: Synthetic peptide
GNGKWGDGAYRFFDF

SEQ ID NO: 8046 - protein, 15 aa, synthetic construct
  source 1..15: note = Description of Artificial Sequence: Synthetic peptide
GEGKWGDGAYRFFDF

SEQ ID NO: 8047 - protein, 15 aa, synthetic construct
  source 1..15: note = Description of Artificial Sequence: Synthetic peptide
GAGKWGDGAYRFFDF

SEQ ID NO: 8048 - protein, 16 aa, synthetic construct
  source 1..16: note = Description of Artificial Sequence: Synthetic peptide
RSSENLVHSNGRTYLQ

SEQ ID NO: 8049 - protein, 7 aa, synthetic construct
  source 1..7: note = Description of Artificial Sequence: Synthetic peptide
RVSNRFP

SEQ ID NO: 8050 - protein, 9 aa, synthetic construct
  source 1..9: note = Description of Artificial Sequence: Synthetic peptide
SQSSLEPYT

SEQ ID NO: 8051 - protein, 16 aa, synthetic construct
  source 1..16: note = Description of Artificial Sequence: Synthetic peptide
RSSKNLVHSNGRTYLQ

SEQ ID NO: 8052 - protein, 9 aa, synthetic construct
  source 1..9: note = Description of Artificial Sequence: Synthetic peptide
SQSTREPYT

SEQ ID NO: 8053 - protein, 9 aa, synthetic construct
  source 1..9: note = Description of Artificial Sequence: Synthetic peptide
ITTTGYHWN

SEQ ID NO: 8054 - protein, 16 aa, synthetic construct
  source 1..16: note = Description of Artificial Sequence: Synthetic peptide
YIYSSGSTSYNPSLKS

SEQ ID NO: 8055 - protein, 8 aa, synthetic construct
  source 1..8: note = Description of Artificial Sequence: Synthetic peptide
GDWHYFDY

SEQ ID NO: 8056 - protein, 11 aa, synthetic construct
  source 1..11: note = Description of Artificial Sequence: Synthetic peptide
SGEKLSDKYVH

SEQ ID NO: 8057 - protein, 7 aa, synthetic construct
  source 1..7: note = Description of Artificial Sequence: Synthetic peptide
ENDRRPS

SEQ ID NO: 8058 - protein, 10 aa, synthetic construct
  source 1..10: note = Description of Artificial Sequence: Synthetic peptide
QFWDSTNSAV

SEQ ID NO: 8059 - protein, 124 aa, synthetic construct
  source 1..124: note = Description of Artificial Sequence: Synthetic polypeptide
QVQLVQSGAEVKKPGASVKVSCKASRSGFHGYAMHWVRQAPGQGLEWMGFINPYNDDIQYNQKFQGRVTITADESTSTAYMELSSLRSEDTAVYYCARGNGKWGDGAYRFFDFWGQGTLVTVSS

SEQ ID NO: 8060 - protein, 112 aa, synthetic construct; identical to SEQ ID NO: 7419
  source 1..112: note = Description of Artificial Sequence: Synthetic polypeptide

SEQ ID NO: 8061 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGYINPYNRDIKYNQKFQGRVTITADKSTTTAYMELSSLRSEDTAVYYCARGNGKWGDGAYRFFDFWGQGTLVTVSS

SEQ ID NO: 8062 - protein, 112 aa, synthetic construct; identical to SEQ ID NO: 7419
  source 1..112: note = Description of Artificial Sequence: Synthetic polypeptide

SEQ ID NO: 8063 - protein, 124 aa, synthetic construct
  source 1..124: note = Description of Artificial Sequence: Synthetic polypeptide
QVQLVQSGAEVKKPGSSVKVSCKASPRGFHGYHMHWVRQAPGQGLEWMGYINPYTGDIKYNERFRGRVTITSDESTTTAYMELSSLRSEDTAVYYCARGNGKWGDGAYRFFDLWGQGTLVTVSS

SEQ ID NO: 8064 - protein, 112 aa, synthetic construct
  source 1..112: note = Description of Artificial Sequence: Synthetic polypeptide
DVVMTQSPLSLPVTLGQPASISCRSSENLVHSNGRTYLQWYQQRPGQSPRLLIYRVSNRFPGVPDRFSGSGSGTDFTLKISRVEAEDVGVYFCSQSTLEPFTFGGGTKVEIK

SEQ ID NO: 8065 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYNDDIQYNERFRGRVTITSDESTTTAYMELSSLRSEDTAVYYCALGNGKWGDGAYRFFDLWGQGTLVTVSS

SEQ ID NO: 8066 - protein, 112 aa, synthetic construct
  source 1..112: note = Description of Artificial Sequence: Synthetic polypeptide
DVVMTQSPLSLPVTLGQPASISCRSSQNLVHSNGRTYLQWYQQRPGQSPRLLIYRVSNRFPGVPDRFSGSGSGTDFTLKISRVEAEDVGVYFCSQSSLLPYTFGGGTKVEIK

SEQ ID NO: 8067 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYNDDIQYNQKFQGRVTITADKSTTTAYMELSSLRSEDTAVYYCARGNGKWGDGAYRFFDFWGQGTLVTVSS

SEQ ID NO: 8068 - protein, 112 aa, synthetic construct; identical to SEQ ID NO: 7419
  source 1..112: note = Description of Artificial Sequence: Synthetic polypeptide

SEQ ID NO: 8069 - protein, 124 aa, synthetic construct; identical to SEQ ID NO: 8065
  source 1..124: note = Description of Artificial Sequence: Synthetic polypeptide

SEQ ID NO: 8070 - protein, 112 aa, synthetic construct; identical to SEQ ID NO: 8066
  source 1..112: note = Description of Artificial Sequence: Synthetic polypeptide

SEQ ID NO: 8071 - protein, 124 aa, synthetic construct; identical to SEQ ID NO: 8067
  source 1..124: note = Description of Artificial Sequence: Synthetic polypeptide

SEQ ID NO: 8072 - protein, 112 aa, synthetic construct; identical to SEQ ID NO: 7419
  source 1..112: note = Description of Artificial Sequence: Synthetic polypeptide

SEQ ID NO: 8073 - protein, 124 aa, synthetic construct
  source 1..124: note = Description of Artificial Sequence: Synthetic polypeptide
QVQLVQSGAEVKKPGASVKVSCKASRSGFHGYAMHWVRQAPGQGLEWMGFINPYNDDIQYNQKFQGRVTITADESTSTAYMELSSLRSEDTAVYYCARGNGKWGDGAYRFFDLWGQGTLVTVSS

SEQ ID NO: 8074 - protein, 112 aa, synthetic construct
  source 1..112: note = Description of Artificial Sequence: Synthetic polypeptide
DVVMTQSPLSLPVTLGQPASISCRSSQNLVHSNARTYLQWYQQRPGQSPRLLIYRVSNRFPGVPDRFSGSGSGTDFTLKISRVEAEDVGVYFCSQSTHVPYTFGGGTKVEIK

SEQ ID NO: 8075 - protein, 124 aa, synthetic construct
  source 1..124: note = Description of Artificial Sequence: Synthetic polypeptide
QVQLVQSGAEVKKPGSSVKVSCKASPRGFHGYHMHWVRQAPGQGLEWMGSINPYTRHIQYNERFRGRVTITSDESTTTAYMELSSLRSEDTAVYYCARGNGKWGDGAYRFFDFWGQGTLVTVSS

SEQ ID NO: 8076 - protein, 112 aa, synthetic construct
  source 1..112: note = Description of Artificial Sequence: Synthetic polypeptide
DVVMTQSPLSLPVTLGQPASISCRSSQNLVHSNGRTYLQWYQQRPGQSPRLLIYRVSNRFPGVPDRFSGSGSGTDFTLKISRVEAEDVGVYFCSQSSYVPFTFGGGTKVEIK

SEQ ID NO: 8077 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGTINPYNRDIQYNQKFQGRVTITADKSTSTAYMELSSLRSEDTAVYYCARGNGKWGDGAYRFFDLWGQGTLVTVSS

SEQ ID NO: 8078 - protein, 112 aa, synthetic construct; identical to SEQ ID NO: 7419
  source 1..112: note = Description of Artificial Sequence: Synthetic polypeptide

SEQ ID NO: 8079 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGTINPYNRDIQYNQKFQGRVTITADKSTSTAYMELSSLRSEDTAVYYCARGNGKWGDGAYRFFDFWGQGTLVTVSS

SEQ ID NO: 8080 - protein, 112 aa, synthetic construct; identical to SEQ ID NO: 7418
  source 1..112: note = Description of Artificial Sequence: Synthetic polypeptide

SEQ ID NO: 8081 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGYINPYTNEIKYNERFRGRVTITSDESTTTAYMELSSLRSEDTAVYYCARGNGKWGDGAYRFFDLWGQGTLVTVSS

SEQ ID NO: 8082 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYNDDIQYNQKFQGRVTITADESTSTAYMELSSLRSEDTAVYYCARGNGKWGDGAYRFFDFWGQGTLVTVSS

SEQ ID NO: 8083 - protein, 112 aa, synthetic construct; identical to SEQ ID NO: 7419
  source 1..112: note = Description of Artificial Sequence: Synthetic polypeptide

SEQ ID NO: 8084 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGTINPYNAEIKYNQKFQGRVTITADKSTSTAYMELSSLRSEDTAVYYCARGNGKWGDGAYRFFDFWGQGTLVTVSS

SEQ ID NO: 8085 - protein, 112 aa, synthetic construct
  source 1..112: note = Description of Artificial Sequence: Synthetic polypeptide
DVVMTQSPLSLPVTPGEPASISCRSSQNLVHSNGRTYLQWYLQKPGQSPQLLIYRVSNRFPGVPDRFSGSGSGTDFTLKISRVEAEDVGVYYCSQSTYEPFTFGGGTKVEIK

SEQ ID NO: 8086 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYNRDIKYNERFRGRVTITSDKSTTTAYMELSSLRSEDTAVYYCAMGNGKWGDGAYRFFDLWGQGTLVTVSS

SEQ ID NO: 8087 - protein, 112 aa, synthetic construct
  source 1..112: note = Description of Artificial Sequence: Synthetic polypeptide
DVVMTQSPLSLPVTLGQPASISCRSSKNLVHSNGRTYLQWYQQRPGQSPRLLIYRVSNRFPGVPDRFSGSGSGTDFTLKISRVEAEDVGVYFCSQSSHIPYTFGGGTKVEIK

SEQ ID NO: 8088 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGAINPYTNDIKYNERFRGRVTITSDKSTTTAYMELSSLRSEDTAVYYCARGNGKWGDGAYRFFDLWGQGTLVTVSS

SEQ ID NO: 8089 - protein, 112 aa, synthetic construct; identical to SEQ ID NO: 7419
  source 1..112: note = Description of Artificial Sequence: Synthetic polypeptide

SEQ ID NO: 8090 - protein, 124 aa, synthetic construct
  source 1..124: note = Description of Artificial Sequence: Synthetic polypeptide
QVQLVHSGAEVKKPGSSVKVSCKASPRGFYGYHMHWVRQAPGQGLEWMGTINPYNRHIKYNQKFQGRVTITADKSTTTAYMELSSLRSEDTAVYYCARGNGKWGDGAYRFFDFWGQGTLVTVSS

SEQ ID NO: 8091 - protein, 112 aa, synthetic construct; identical to SEQ ID NO: 7419
  source 1..112: note = Description of Artificial Sequence: Synthetic polypeptide

SEQ ID NO: 8092 - protein, 124 aa, synthetic construct
  source 1..124: note = Description of Artificial Sequence: Synthetic polypeptide
QVQLVQSGAEVKKPGASVKVSCKASPRGFHGYHMHWVRQAPGQGLEWMGSINPYTDDIQYNERFRGRVTITSDESTTTAYMELSSLRSEDTAVYYCARGNGKWGDGAYRFFDFWGQGTLVTVSS

SEQ ID NO: 8093 - protein, 112 aa, synthetic construct
  source 1..112: note = Description of Artificial Sequence: Synthetic polypeptide
DVVMTQSPLSLPVTLGQPASISCRSSENLVHSNGRTYLQWYQQRPGQSPRLLIYRVSNRFPGVPDRFSGSGSGTDFTLKISRVEAEDVGVYFCSQSTHVPYTFGGGTKVEIK

SEQ ID NO: 8094 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGAINPYTNHIQYNERFRGRVTITSDESTTTAYMELSSLRSEDTAVYYCARGNGKWGDGAYRFFDLWGQGTLVTVSS

SEQ ID NO: 8095 - protein, 112 aa, synthetic construct
  source 1..112: note = Description of Artificial Sequence: Synthetic polypeptide
DVVMTQSPLSLPVTLGQPASISCRSSQNLVHSNGRTYLQWYQQRPGQSPRLLIYRVSNRFPGVPDRFSGSGSGTDFTLKISRVEAEDVGVYFCSQSTHVPYTFGGGTKVEIK

SEQ ID NO: 8096 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYNDDIQYNQKFQGRVTITADKSTSTAYMELSSLRSEDTAVYYCARGNGKWGDGAYRFFDFWGQGTLVTVSS

SEQ ID NO: 8097 - protein, 112 aa, synthetic construct
  source 1..112: note = Description of Artificial Sequence: Synthetic polypeptide
DVVMTQSPLSLPVTLGQPASISCRSSQNLVHSNARTYLQWYQQRPGQSPRLLIYRVSNRFPGVPDRFSGSGSGTDFTLKISRVEAEDVGVYYCSQSTYIPYTFGGGTKVEIK

SEQ ID NO: 8098 - protein, 124 aa, synthetic construct
  source 1..124: note = Description of Artificial Sequence: Synthetic polypeptide
QVQLVQSGAEVKKPGSSVKVSCKASPRGFHGYHMHWVRQAPGQGLEWMGFINPYTRAIKYNERFRGRVTITSDKSTTTAYMELSSLRSEDTAVYYCARGNGKWGDGAYRFFDLWGQGTLVTVSS

SEQ ID NO: 8099 - protein, 112 aa, synthetic construct
  source 1..112: note = Description of Artificial Sequence: Synthetic polypeptide
DVVMTQSPLSLPVTLGQPASISCRSSQNLVHSNGRTYLQWYLQKPGQSPQLLIYRVSNRFPGVPDRFSGSGSGTDFTLKISRVEAEDVGVYFCSQSTHVPYTFGGGTKVEIK

SEQ ID NO: 8100 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGAINPYTRAIKYNERFRGRVTITSDESTTTAYMELSSLRSEDTAVYYCARGNGKWGDGAYRFFDLWGQGTLVTVSS

SEQ ID NO: 8101 - protein, 112 aa, synthetic construct
  source 1..112: note = Description of Artificial Sequence: Synthetic polypeptide
DVVMTQSPLSLPVTLGQPASISCRSSQNLVHSNGRTYLQWYQQRPGQSPRLLIYRVSNRFPGVPDRFSGSGSGTDFTLKISRVEAEDVGVYFCSQSTYEPYTFGGGTKVEIK

SEQ ID NO: 8102 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGTINPYNGDIQYNERFRGRVTMTSDKSTTTAYMELSSLRSEDTAVYYCARGNGKWGDGAYRFFDFWGQGTLVTVSS

SEQ ID NO: 8103 - protein, 112 aa, synthetic construct; identical to SEQ ID NO: 7419
  source 1..112: note = Description of Artificial Sequence: Synthetic polypeptide

SEQ ID NO: 8104 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGAINPYNTDIKYNERFRGRVTITSDESTTTAYMELSSLRSEDTAVYYCARGNGKWGDGAYRFFDLWGQGTLVTVSS

SEQ ID NO: 8105 - protein, 112 aa, synthetic construct; identical to SEQ ID NO: 8095
  source 1..112: note = Description of Artificial Sequence: Synthetic polypeptide

SEQ ID NO: 8106 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGYINPYNGAIKYNQKFQGRVTITADESTSTAYMELSSLRSEDTAVYYCARGNGKWGDGAYRFFDLWGQGTLVTVSS

SEQ ID NO: 8107 - protein, 112 aa, synthetic construct; identical to SEQ ID NO: 8099
  source 1..112: note = Description of Artificial Sequence: Synthetic polypeptide

SEQ ID NO: 8108 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGAINPYNDDIQSNERFRGRVTITSDKSTTTAYMELSSLRSEDTAVYYCARGNGKWGDGAYRFFDLWGQGTLVTVSS

SEQ ID NO: 8109 - protein, 112 aa, synthetic construct; identical to SEQ ID NO: 8099
  source 1..112: note = Description of Artificial Sequence: Synthetic polypeptide

SEQ ID NO: 8110 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYNRAIQYNQKFQGRVTITADKSTTTAYMELSSLRSEDTAVYYCARGNGKWGDGAYRFFDFWGQGTLVTVSS

SEQ ID NO: 8111 - skipped

SEQ ID NO: 8112 - protein, 112 aa, synthetic construct; identical to SEQ ID NO: 7419
  source 1..112: note = Description of Artificial Sequence: Synthetic polypeptide

SEQ ID NO: 8113 - protein, 124 aa, synthetic construct
  source 1..124: note = Description of Artificial Sequence: Synthetic polypeptide
QVQLVQSGAEVKKPGASVKVSCKASPRGFHGYHMHWVRQAPGQGLEWMGFINPYTNEIQYNERFRGRVTITSDESTTTAYMELSSLRSEDTAVYYCARGNGKWGDGAYRFFDLWGQGTLVTVSS

SEQ ID NO: 8114 - protein, 112 aa, synthetic construct; identical to SEQ ID NO: 8095
  source 1..112: note = Description of Artificial Sequence: Synthetic polypeptide

SEQ ID NO: 8115 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGYINPYNHDIQYNQKFQGRVTITADKSTSTAYMELSSLRSEDTAVYYCARGNGKWGDGAYRFFDFWGQGTLVTVSS

SEQ ID NO: 8116 - protein, 112 aa, synthetic construct; identical to SEQ ID NO: 7419
  source 1..112: note = Description of Artificial Sequence: Synthetic polypeptide

SEQ ID NO: 8117 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGSINPYTHDIQYNERFRGRVTITSDESTTTAYMELSSLRSEDTAVYYCARGNGKWGDGAYRFFDLWGQGTLVTVSS

SEQ ID NO: 8118 - protein, 112 aa, synthetic construct; identical to SEQ ID NO: 8099
  source 1..112: note = Description of Artificial Sequence: Synthetic polypeptide

SEQ ID NO: 8119 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGYINPYKNAIQYNQKFQGRVTITADKSTTTAYMELSSLRSEDTAVYYCARGNGKWGDGAYRFFDFWGQGTLVTVSS

SEQ ID NO: 8120 - protein, 112 aa, synthetic construct; identical to SEQ ID NO: 7419
  source 1..112: note = Description of Artificial Sequence: Synthetic polypeptide

SEQ ID NO: 8121 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGAINPYNTDIQYNERFRGRVTITSDKSTTTAYMELSSLRSEDTAVYYCARGNGKWGDGAYRFFDFWGQGTLVTVSS

SEQ ID NO: 8122 - protein, 112 aa, synthetic construct
  source 1..112: note = Description of Artificial Sequence: Synthetic polypeptide
DVVMTQSPLSLPVTLGQPASISCRSSENLVHSNGRTYLQWYQQRPGQSPRLLIYRVSNRFPGVPDRFSGSGSGTDFTLKISRVEAEDVGVYFCSQSSHIPYTFGGGTKVEIK

SEQ ID NO: 8123 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGSINPYNGDIQYNERFRGRVTITSDKSTTTAYMELSSLRSEDTAVYYCARGNGKWGDGAYRFFDFWGQGTLVTVSS

SEQ ID NO: 8124 - protein, 112 aa, synthetic construct
  source 1..112: note = Description of Artificial Sequence: Synthetic polypeptide
DVVMTQSPLSLPVTLGQPASISCRSSQNLVHSNGRTYLQWYQQRPGQSPRLLIYRVSNRFPGVPDRFSGSGSGTDFTLKISRVEAEDVGVYFCSQSTHLPYTFGGGTKVEIK

SEQ ID NO: 8125 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGTINPYNHDAQYNERFRGRVTITSDKSTTTAYMELSSLRSEDTAVYYCARGNGKWGDGAYRFFDFWGQGTLVTVSS

SEQ ID NO: 8126 - protein, 112 aa, synthetic construct; identical to SEQ ID NO: 7419
  source 1..112: note = Description of Artificial Sequence: Synthetic polypeptide

SEQ ID NO: 8127 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYNHAIKYNQKFQGRVTITADKSTSTAYMELSSLRSEDTAVYYCARGNGKWGDGAYRFFDFWGQGTLVTVSS

SEQ ID NO: 8128 - protein, 112 aa, synthetic construct; identical to SEQ ID NO: 7418
  source 1..112: note = Description of Artificial Sequence: Synthetic polypeptide

SEQ ID NO: 8129 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGYINPYNNAIQYNQKFQGRVTMTSDKSTTTAYMELSSLRSEDTAVYYCARGNGKWGDGAYRFFDFWGQGTLVTVSS

SEQ ID NO: 8130 - protein, 112 aa, synthetic construct; identical to SEQ ID NO: 8099
  source 1..112: note = Description of Artificial Sequence: Synthetic polypeptide

SEQ ID NO: 8131 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYTNDIQYNERFRGRVTITSDKSTTTAYMELSSLRSEDTAVYYCAMGNGKWGDGAYRFFDLWGQGTLVTVSS

SEQ ID NO: 8132 - protein, 112 aa, synthetic construct; identical to SEQ ID NO: 8095
  source 1..112: note = Description of Artificial Sequence: Synthetic polypeptide

SEQ ID NO: 8133 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGAINPYTNEIKYNERFRGRVTITSDESTTTAYMELSSLRSEDTAVYYCARGNGKWGDGAYRFFDFWGQGTLVTVSS

SEQ ID NO: 8134 - protein, 112 aa, synthetic construct; identical to SEQ ID NO: 8124
  source 1..112: note = Description of Artificial Sequence: Synthetic polypeptide

SEQ ID NO: 8135 - protein, 124 aa, synthetic construct; identical to SEQ ID NO: 8096
  source 1..124: note = Description of Artificial Sequence: Synthetic polypeptide

SEQ ID NO: 8136 - protein, 112 aa, synthetic construct; identical to SEQ ID NO: 7419
  source 1..112: note = Description of Artificial Sequence: Synthetic polypeptide

SEQ ID NO: 8137 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGAINPYNDDIQYNERFRGRVTITSDESTTTAYMELSSLRSEDTAVYYCALGNGKWGDGAYRFFDFWGQGTLVTVSS

SEQ ID NO: 8138 - protein, 112 aa, synthetic construct; identical to SEQ ID NO: 7419
  source 1..112: note = Description of Artificial Sequence: Synthetic polypeptide

SEQ ID NO: 8139 - protein, 124 aa, synthetic construct
  source 1..124: note = Description of Artificial Sequence: Synthetic polypeptide
QVQLVQSGAEVKKPGASVKVSCKASPRGFHGYHMHWVRQAPGQGLEWMGYINPYNNDIKYNQKFQGRVTITADESTSTAYMELSSLRSEDTAVYYCARGNGKWGDGAYRFFDFWGQGTLVTVSS

SEQ ID NO: 8140 - protein, 112 aa, synthetic construct; identical to SEQ ID NO: 8099
  source 1..112: note = Description of Artificial Sequence: Synthetic polypeptide

SEQ ID NO: 8141 - protein, 124 aa, synthetic construct
  source 1..124: note = Description of Artificial Sequence: Synthetic polypeptide
QVQLVQSGAEVKKPGSSVKVSCKASPRGFHGYHMHWVRQAPGQGLEWMGFINPYTNDIQYNERFRGRVTITSDESTTTAYMELSSLRSEDTAVYYCALGNGKWGDGAYRFFDLWGQGTLVTVSS

SEQ ID NO: 8142 - protein, 112 aa, synthetic construct; identical to SEQ ID NO: 8099
  source 1..112: note = Description of Artificial Sequence: Synthetic polypeptide

SEQ ID NO: 8143 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGTINPYKHHIKYNERFRGRVTITSDESTTTAYMELSSLRSEDTAVYYCARGNGKWGDGAYRFFDLWGQGTLVTVSS

SEQ ID NO: 8144 - protein, 112 aa, synthetic construct
  source 1..112: note = Description of Artificial Sequence: Synthetic polypeptide
DVVMTQSPLSLPVTLGQPASISCRSSENLVHSNGRTYLQWYQQRPGQSPRLLIYRVSNRFPGVPDRFSGSGSGTDFTLKISRVEAEDVGVYFCSQSTQEPYTFGGGTKVEIK

SEQ ID NO: 8145 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGTINPYNGDIQYNERFRGRVTITSDESTTTAYMELSSLRSEDTAVYYCARGNGKWGDGAYRFFDFWGQGTLVTVSS

SEQ ID NO: 8146 - protein, 112 aa, synthetic construct; identical to SEQ ID NO: 7419
  source 1..112: note = Description of Artificial Sequence: Synthetic polypeptide

SEQ ID NO: 8147 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGAINPYNDDIKYNERFRGRVTITSDKSTTTAYMELSSLRSEDTAVYYCALGNGKWGDGAYRFFDFWGQGTLVTVSS

SEQ ID NO: 8148 - protein, 112 aa, synthetic construct; identical to SEQ ID NO: 8099
  source 1..112: note = Description of Artificial Sequence: Synthetic polypeptide

SEQ ID NO: 8149 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGYINPYTHEIKYNERFRGRVTITSDESTTTAYMELSSLRSEDTAVYYCARGNGKWGDGAYRFFDFWGQGTLVTVSS

SEQ ID NO: 8150 - protein, 112 aa, synthetic construct
  source 1..112: note = Description of Artificial Sequence: Synthetic polypeptide
DVVMTQSPLSLPVTLGQPASISCRSSKNLVHSNARTYLQWYQQRPGQSPRLLIYRVSNRFPGVPDRFSGSGSGTDFTLKISRVEAEDVGVYFCSQSTHVPYTFGGGTKVEIK

SEQ ID NO: 8151 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYKDDIKYNERFRGRVTITSDKSTTTAYMELSSLRSEDTAVYYCALGNGKWGDGAYRFFDFWGQGTLVTVSS

SEQ ID NO: 8152 - protein, 112 aa, synthetic construct
  source 1..112: note = Description of Artificial Sequence: Synthetic polypeptide
DVVMTQSPLSLPVTLGQPASISCRSSKNLVHSNGRTYLQWYQQRPGQSPRLLIYRVSNRFPGVPDRFSGSGSGTDFTLKISRVEAEDVGVYFCSQSSLVPYTFGGGTKVEIK

SEQ ID NO: 8153 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGAINPYNDDIQSNERFRGRVTITSDKSTTTAYMELSSLRSEDTAVYYCARGNGKWGDGAYRFFDFWGQGTLVTVSS

SEQ ID NO: 8154 - protein, 112 aa, synthetic construct; identical to SEQ ID NO: 7418
  source 1..112: note = Description of Artificial Sequence: Synthetic polypeptide

SEQ ID NO: 8155 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGAINPYNDDIKYNQKFQGRVTITADESTTTAYMELSSLRSEDTAVYYCARGNGKWGDGAYRFFDFWGQGTLVTVSS

SEQ ID NO: 8156 - protein, 112 aa, synthetic construct; identical to SEQ ID NO: 7418
  source 1..112: note = Description of Artificial Sequence: Synthetic polypeptide

SEQ ID NO: 8157 - protein, 124 aa, synthetic construct
  source 1..124: note = Description of Artificial Sequence: Synthetic polypeptide
QVQLVQSGAEVKKPGSSLKVSCKASPRGFHGYHMHWVRQAPGQGLEWMGAINPYNRDIKYNERFRGRVTITSDESTTTAYMELSSLRSEDTAVYYCARGNGKWGDGAYRFFDLWGQGTLVTVSS

SEQ ID NO: 8158 - protein, 112 aa, synthetic construct
  source 1..112: note = Description of Artificial Sequence: Synthetic polypeptide
DVVMTQSPLSLPVTLGQPASISCRSSKNLVHSNGRTYLQWYQQRPGQSPRLLIYRVSNRFPGVPDRFSGSGSGTDFTLKISRVEAEDVGVYFCSQSTHVPYTFGGGTKVEIK

SEQ ID NO: 8159 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGAINPYNGDIKYNERFRGRVTITSDKSTTTAYMELSSLRSEDTAVYYCARGNGKWGDGAYRFFDFWGQGTLVTVSS

SEQ ID NO: 8160 - protein, 112 aa, synthetic construct; identical to SEQ ID NO: 7419
  source 1..112: note = Description of Artificial Sequence: Synthetic polypeptide

SEQ ID NO: 8161 - protein, 124 aa, synthetic construct; identical to SEQ ID NO: 8013
  source 1..124: note = Description of Artificial Sequence: Synthetic polypeptide

SEQ ID NO: 8162 - protein, 112 aa, synthetic construct; identical to SEQ ID NO: 8014
  source 1..112: note = Description of Artificial Sequence: Synthetic polypeptide

SEQ ID NO: 8163 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGYINPYTRDIKYNERFRGRVTITSDESTTTAYMELSSLRSEDTAVYYCARGNGKWGDGAYRFFDFWGQGTLVTVSS

SEQ ID NO: 8164 - protein, 112 aa, synthetic construct
  source 1..112: note = Description of Artificial Sequence: Synthetic polypeptide
DVVMTQSPLSLPVTLGQPASISCRSSQNLVHSNGRTYLQWYQQRPGQSPRLLIYRVSNRFPGVPDRFSGSGSGTDFTLKISRVEAEDVGVYFCSQSTQMPYTFGGGTKVEIK

SEQ ID NO: 8165 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGTINPYNTDIKYNERFRGRVTITSDKSTTTAYMELSSLRSEDTAVYYCARGNGKWGDGAYRFFDLWGQGTLVTVSS

SEQ ID NO: 8166 - protein, 112 aa, synthetic construct
  source 1..112: note = Description of Artificial Sequence: Synthetic polypeptide
DVVMTQSPLSLPVTLGQPASISCRSSQNLVHSNARTYLQWYQQRPGQSPRLLIYRVSNRFPGVPDRFSGSGSGTDFTLKISRVEAEDVGVYFCSQSTYEPYTFGGGTKVEIK

SEQ ID NO: 8167 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGTINPYNNDIQYNERFRGRVTITSDKSTTTAYMELSSLRSEDTAVYYCARGNGKWGDGAYRFFDFWGQGTLVTVSS

SEQ ID NO: 8168 - protein, 112 aa, synthetic construct
  source 1..112: note = Description of Artificial Sequence: Synthetic polypeptide
DVVMTQSPLSLPVTLGQPASISCRSSQNLVHSNGRTYLHWYLQKPGQSPQLLIYRVSNRFPGVPDRFSGSGSGTDFTLKISRVEAEDVGVYFCSQSTHVPYTFGGGTKVEIK

SEQ ID NO: 8169 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGYINPYNGNIQYNERFRGRVTITSDESTTTAYMELSSLRSEDTAVYYCARGNGKWGDGAYRFFDFWGQGTLVTVSS

SEQ ID NO: 8170 - protein, 112 aa, synthetic construct
  source 1..112: note = Description of Artificial Sequence: Synthetic polypeptide
DVVMTQSPLSLPVTLGQPASISCRSSKNLVHSNGRTYLQWYQQRPGQSPRLLIYRVSNRFPGVPDRFSGSGSGTDFTLKISRVEAEDVGVYFCSQSSQEPYTFGGGTKVEIK

SEQ ID NO: 8171 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGAINPYTNEIQYNERFRGRVTITSDESTTTAYMELSSLRSEDTAVYYCARGNGKWGDGAYRFFDFWGQGTLVTVSS

SEQ ID NO: 8172 - protein, 112 aa, synthetic construct; identical to SEQ ID NO: 7419
  source 1..112: note = Description of Artificial Sequence: Synthetic polypeptide

SEQ ID NO: 8173 - protein, 124 aa, synthetic construct
  source 1..124: note = Description of Artificial Sequence: Synthetic polypeptide
QVQLVQSGAEVKKPGASVKVSCKASPRGFYGYHMHWVRQAPGQGLEWMGSINPYNHDIKYNERFRGRVTITSDKSTTTAYMELSSLRSEDTAVYYCARGNGKWGDGAYRFFDFWGQGTLVTVSS

SEQ ID NO: 8174 - protein, 112 aa, synthetic construct; identical to SEQ ID NO: 7419
  source 1..112: note = Description of Artificial Sequence: Synthetic polypeptide

SEQ ID NO: 8175 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYKNEIKYNERFRGRVTITSDESTTTAYMELSSLRSEDTAVYYCARGNGKWGDGAYRFFDFWGQGTLVTVSS

SEQ ID NO: 8176 - protein, 112 aa, synthetic construct; identical to SEQ ID NO: 7419
  source 1..112: note = Description of Artificial Sequence: Synthetic polypeptide

SEQ ID NO: 8177 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGYINPYNNEIQYNERFRGRVTITSDESTTTAYMELSSLRSEDTAVYYCARGNGKWGDGAYRFFDFWGQGTLVTVSS

SEQ ID NO: 8178 - protein, 112 aa, synthetic construct; identical to SEQ ID NO: 7418
  source 1..112: note = Description of Artificial Sequence: Synthetic polypeptide

SEQ ID NO: 8179 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGSINPYNRHIQYNERFRGRVTITSDKSTTTAYMELSSLRSEDTAVYYCARGNGKWGDGAYRFFDFWGQGTLVTVSS

SEQ ID NO: 8180 - protein, 112 aa, synthetic construct; identical to SEQ ID NO: 7419
  source 1..112: note = Description of Artificial Sequence: Synthetic polypeptide

SEQ ID NO: 8181 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGSINPYTREIQYNERFRGRVTITSDKSTTTAYMELSSLRSEDTAVYYCARGNGKWGDGAYRFFDLWGQGTLVTVSS

SEQ ID NO: 8182 - protein, 112 aa, synthetic construct; identical to SEQ ID NO: 8099
  source 1..112: note = Description of Artificial Sequence: Synthetic polypeptide

SEQ ID NO: 8183 - protein, 124 aa, synthetic construct; identical to SEQ ID NO: 8011
  source 1..124: note = Description of Artificial Sequence: Synthetic polypeptide

SEQ ID NO: 8184 - protein, 112 aa, synthetic construct; identical to SEQ ID NO: 8012
  source 1..112: note = Description of Artificial Sequence: Synthetic polypeptide

SEQ ID NO: 8185 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYNDDIQSNERFQGRVTITADESTSTAYMELSSLRSEDTAVYYCAMGNGKWGDGAYRFFDLWGQGTLVTVSS

SEQ ID NO: 8186 - protein, 112 aa, synthetic construct; identical to SEQ ID NO: 8099
  source 1..112: note = Description of Artificial Sequence: Synthetic polypeptide

SEQ ID NO: 8187 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGSINPYTHNIKYNERFRGRVTITSDESTTTAYMELSSLRSEDTAVYYCARGNGKWGDGAYRFFDFWGQGTLVTVSS

SEQ ID NO: 8188 - protein, 112 aa, synthetic construct; identical to SEQ ID NO: 8095
  source 1..112: note = Description of Artificial Sequence: Synthetic polypeptide

SEQ ID NO: 8189 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGYINPYNHEIKYNQKFQGRVTITADKSTTTAYMELSSLRSEDTAVYYCARGNGKWGDGAYRFFDFWGQGTLVTVSS

SEQ ID NO: 8190 - protein, 112 aa, synthetic construct; identical to SEQ ID NO: 7418
  source 1..112: note = Description of Artificial Sequence: Synthetic polypeptide

SEQ ID NO: 8191 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGSINPYTRNIQYNQKFRGRVTMTSDKSTTTAYMELSSLRSEDTAVYYCARGNGKWGDGAYRFFDFWGQGTLVTVSS

SEQ ID NO: 8192 - protein, 112 aa, synthetic construct; identical to SEQ ID NO: 7419
  source 1..112: note = Description of Artificial Sequence: Synthetic polypeptide

SEQ ID NO: 8193 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGYINPYNGAIQYNQKFQGRVTITADESTSTAYMELSSLRSEDTAVYYCARGNGKWGDGAYRFFDLWGQGTLVTVSS

SEQ ID NO: 8194 - protein, 112 aa, synthetic construct; identical to SEQ ID NO: 7419
  source 1..112: note = Description of Artificial Sequence: Synthetic polypeptide

SEQ ID NO: 8195 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGTINPYTREIQYNQKFQGRVTITADKSTTTAYMELSSLRSEDTAVYYCARGNGKWGDGAYRFFDFWGQGTLVTVSS

SEQ ID NO: 8196 - protein, 112 aa, synthetic construct; identical to SEQ ID NO: 7418
  source 1..112: note = Description of Artificial Sequence: Synthetic polypeptide

SEQ ID NO: 8197 - protein, 124 aa, synthetic construct
  source 1..124: note = Description of Artificial Sequence: Synthetic polypeptide
QVQLVQSGAEVKKPGSSVKVSCKASPRGFYGYAMHWVRQAPGQGLEWMGYINPYNNEIQYNQKFQGRVTITADKSTTTAYMELSSLRSEDTAVYYCARGNGKWGDGAYRFFDFWGQGTLVTVSS

SEQ ID NO: 8198 - protein, 112 aa, synthetic construct; identical to SEQ ID NO: 7419
  source 1..112: note = Description of Artificial Sequence: Synthetic polypeptide

SEQ ID NO: 8199 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGAINPYNHEIQYNQKFQGRVTITADKSTTTAYMELSSLRSEDTAVYYCARGNGKWGDGAYRFFDFWGQGTLVTVSS

SEQ ID NO: 8200 - protein, 112 aa, synthetic construct
  source 1..112: note = Description of Artificial Sequence: Synthetic polypeptide
DVVMTQSPLSLPVTPGEPASISCRSSQNLVHSNGRTYLQWYLQKPGQSPQLLIYRVSNRFPGVPDRFSGSGSGTDFTLKISRVEAEDVGVYYCSQSTHVPYTFGGGTKVEIK

SEQ ID NO: 8201 - protein, 124 aa, synthetic construct
  source 1..124: note = Description of Artificial Sequence: Synthetic polypeptide
QVQLVQSGAEVKKPGSSVKVSCKASPRGFHGYHMHWVRQAPGQGLEWMGFINPYNDDIQYNQKFQGRVTITADESTSTAYMELSSLRSEDTAVYYCARGNGKWGDGAYRFFDFWGQGTLVTVSS

SEQ ID NO: 8202 - protein, 112 aa, synthetic construct; identical to SEQ ID NO: 7419
  source 1..112: note = Description of Artificial Sequence: Synthetic polypeptide

SEQ ID NO: 8203 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYNDDIQYNQKFQGRVTITADESTSTAYMELSSLRSEDTAVYYCAMGNGKWGDGAYRFFDLWGQGTLVTVSS

SEQ ID NO: 8204 - protein, 112 aa, synthetic construct; identical to SEQ ID NO: 8099
  source 1..112: note = Description of Artificial Sequence: Synthetic polypeptide

SEQ ID NO: 8205 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYNHAIKYNQKFQGRVTITADESTSTAYMELSSLRSEDTAVYYCARGNGKWGDGAYRFFDFWGQGTLVTVSS

SEQ ID NO: 8206 - protein, 112 aa, synthetic construct; identical to SEQ ID NO: 7419
  source 1..112: note = Description of Artificial Sequence: Synthetic polypeptide

SEQ ID NO: 8207 - protein, 10 aa, synthetic construct
  source 1..10: note = Description of Artificial Sequence: Synthetic peptide
RSGFHGYAMH

SEQ ID NO: 8208 - protein, 17 aa, synthetic construct
  source 1..17: note = Description of Artificial Sequence: Synthetic peptide
FINPYNDDIQYNQKFQG

SEQ ID NO: 8209 - protein, 16 aa, synthetic construct
  source 1..16: note = Description of Artificial Sequence: Synthetic peptide
RSSQNLVHSNGRTYLQ

SEQ ID NO: 8210 - protein, 9 aa, synthetic construct
  source 1..9: note = Description of Artificial Sequence: Synthetic peptide
SQSTHVPYT

SEQ ID NO: 8211 - protein, 10 aa, synthetic construct
  source 1..10: note = Description of Artificial Sequence: Synthetic peptide
PRGFHGYHMH

SEQ ID NO: 8212 - protein, 17 aa, synthetic construct
  source 1..17: note = Description of Artificial Sequence: Synthetic peptide
YINPYNRDIKYNQKFQG

SEQ ID NO: 8213 - protein, 17 aa, synthetic construct
  source 1..17: note = Description of Artificial Sequence: Synthetic peptide
FINPYNHAIKYNQKFQG

SEQ ID NO: 8214 - protein, 9 aa, synthetic construct
  source 1..9: note = Description of Artificial Sequence: Synthetic peptide
SQSSYVPFT

SEQ ID NO: 8215 - protein, 11 aa, synthetic construct
  source 1..11: note = Description of Artificial Sequence: Synthetic peptide
SRSGFHGYAMH

SEQ ID NO: 8216 - protein, 15 aa, synthetic construct
  source 1..15: note = Description of Artificial Sequence: Synthetic peptide
GNGKWGDGAYRFFDF

SEQ ID NO: 8217 - protein, 17 aa, synthetic construct
  source 1..17: note = Description of Artificial Sequence: Synthetic peptide
YINPYTGDIKYNERFRG

SEQ ID NO: 8218 - protein, 7 aa, synthetic construct
  source 1..7: note = Description of Artificial Sequence: Synthetic peptide
RVSNRFP

SEQ ID NO: 8219 - protein, 10 aa, synthetic construct
  source 1..10: note = Description of Artificial Sequence: Synthetic peptide
PRGFYGYHMH

SEQ ID NO: 8220 - protein, 15 aa, synthetic construct
  source 1..15: note = Description of Artificial Sequence: Synthetic peptide
GNGKWGDGAYRFFDL

SEQ ID NO: 8221 - protein, 17 aa, synthetic construct
  source 1..17: note = Description of Artificial Sequence: Synthetic peptide
FINPYNDDIQYNERFRG

SEQ ID NO: 8222 - protein, 17 aa, synthetic construct
  source 1..17: note = Description of Artificial Sequence: Synthetic peptide
TINPYNAEIKYNQKFQG

SEQ ID NO: 8223 - protein, 9 aa, synthetic construct
  source 1..9: note = Description of Artificial Sequence: Synthetic peptide
SQSTYEPFT

SEQ ID NO: 8224 - protein, 16 aa, synthetic construct
  source 1..16: note = Description of Artificial Sequence: Synthetic peptide
LGNGKWGDGAYRFFDL

SEQ ID NO: 8225 - protein, 17 aa, synthetic construct
  source 1..17: note = Description of Artificial Sequence: Synthetic peptide
TINPYNRDIQYNQKFQG

SEQ ID NO: 8226 - protein, 16 aa, synthetic construct
  source 1..16: note = Description of Artificial Sequence: Synthetic peptide
RSSQNLVHSNGRTYLH

SEQ ID NO: 8227 - protein, 16 aa, synthetic construct
  source 1..16: note = Description of Artificial Sequence: Synthetic peptide
MGNGKWGDGAYRFFDL

SEQ ID NO: 8228 - protein, 17 aa, synthetic construct
  source 1..17: note = Description of Artificial Sequence: Synthetic peptide
FINPYNRDIKYNERFRG

SEQ ID NO: 8229 - protein, 17 aa, synthetic construct
  source 1..17: note = Description of Artificial Sequence: Synthetic peptide
AINPYTNDIKYNERFRG

SEQ ID NO: 8230 - protein, 17 aa, synthetic construct
  source 1..17: note = Description of Artificial Sequence: Synthetic peptide
AINPYTNHIQYNERFRG

SEQ ID NO: 8231 - protein, 17 aa, synthetic construct
  source 1..17: note = Description of Artificial Sequence: Synthetic peptide
AINPYTRAIKYNERFRG

SEQ ID NO: 8232 - protein, 17 aa, synthetic construct
  source 1..17: note = Description of Artificial Sequence: Synthetic peptide
TINPYNGDIQYNERFRG

SEQ ID NO: 8233 - protein, 17 aa, synthetic construct
  source 1..17: note = Description of Artificial Sequence: Synthetic peptide
AINPYNTDIKYNERFRG

SEQ ID NO: 8234 - protein, 17 aa, synthetic construct
  source 1..17: note = Description of Artificial Sequence: Synthetic peptide
YINPYNGAIKYNQKFQG

SEQ ID NO: 8235 - protein, 17 aa, synthetic construct
  source 1..17: note = Description of Artificial Sequence: Synthetic peptide
AINPYNDDIQSNERFRG

SEQ ID NO: 8236 - protein, 17 aa, synthetic construct
  source 1..17: note = Description of Artificial Sequence: Synthetic peptide
FINPYNRAIQYNQKFQG

SEQ ID NO: 8237 - protein, 17 aa, synthetic construct
  source 1..17: note = Description of Artificial Sequence: Synthetic peptide
FINPYTNEIQYNERFRG

SEQ ID NO: 8238 - protein, 17 aa, synthetic construct
  source 1..17: note = Description of Artificial Sequence: Synthetic peptide
SINPYTHDIQYNERFRG

SEQ ID NO: 8239 - protein, 17 aa, synthetic construct
  source 1..17: note = Description of Artificial Sequence: Synthetic peptide
YINPYKNAIQYNQKFQG

SEQ ID NO: 8240 - protein, 17 aa, synthetic construct
  source 1..17: note = Description of Artificial Sequence: Synthetic peptide
AINPYNTDIQYNERFRG

SEQ ID NO: 8241 - protein, 17 aa, synthetic construct
  source 1..17: note = Description of Artificial Sequence: Synthetic peptide
SINPYNGDIQYNERFRG

SEQ ID NO: 8242 - protein, 17 aa, synthetic construct
  source 1..17: note = Description of Artificial Sequence: Synthetic peptide
TINPYNHDAQYNERFRG

SEQ ID NO: 8243 - protein, 17 aa, synthetic construct
  source 1..17: note = Description of Artificial Sequence: Synthetic peptide
AINPYNDDIKYNERFRG

SEQ ID NO: 8244 - protein, 15 aa, synthetic construct
  source 1..15: note = Description of Artificial Sequence: Synthetic peptide
GNGKWGDGAYRFFDF

SEQ ID NO: 8245 - protein, 17 aa, synthetic construct
  source 1..17: note = Description of Artificial Sequence: Synthetic peptide
YINPYTHEIKYNERFRG

SEQ ID NO: 8246 - protein, 17 aa, synthetic construct
  source 1..17: note = Description of Artificial Sequence: Synthetic peptide
FINPYKDDIKYNERFRG

SEQ ID NO: 8247 - protein, 17 aa, synthetic construct
  source 1..17: note = Description of Artificial Sequence: Synthetic peptide
AINPYNDDIKYNQKFQG

SEQ ID NO: 8248 - protein, 17 aa, synthetic construct
  source 1..17: note = Description of Artificial Sequence: Synthetic peptide
AINPYNRDIKYNERFRG

SEQ ID NO: 8249 - protein, 17 aa, synthetic construct
  source 1..17: note = Description of Artificial Sequence: Synthetic peptide
AINPYNGDIKYNERFRG

SEQ ID NO: 8250 - protein, 17 aa, synthetic construct
  source 1..17: note = Description of Artificial Sequence: Synthetic peptide
YINPYTRDIKYNERFRG

SEQ ID NO: 8251 - protein, 17 aa, synthetic construct
  source 1..17: note = Description of Artificial Sequence: Synthetic peptide
TINPYNTDIKYNERFRG

SEQ ID NO: 8252 - protein, 17 aa, synthetic construct
  source 1..17: note = Description of Artificial Sequence: Synthetic peptide
TINPYNNDIQYNERFRG

SEQ ID NO: 8253 - protein, 17 aa, synthetic construct
  source 1..17: note = Description of Artificial Sequence: Synthetic peptide
YINPYNGNIQYNERFRG

SEQ ID NO: 8254 - protein, 17 aa, synthetic construct
  source 1..17: note = Description of Artificial Sequence: Synthetic peptide
AINPYTNEIQYNERFRG

SEQ ID NO: 8255 - protein, 17 aa, synthetic construct
  source 1..17: note = Description of Artificial Sequence: Synthetic peptide
SINPYNHDIKYNERFRG

SEQ ID NO: 8256 - protein, 17 aa, synthetic construct
  source 1..17: note = Description of Artificial Sequence: Synthetic peptide
FINPYKNEIKYNERFRG

SEQ ID NO: 8257 - protein, 18 aa, synthetic construct
  source 1..18: note = Description of Artificial Sequence: Synthetic peptide
YINPYNNEIQYNERFRGR

SEQ ID NO: 8258 - protein, 17 aa, synthetic construct
  source 1..17: note = Description of Artificial Sequence: Synthetic peptide
SINPYNRHIQYNERFRG

SEQ ID NO: 8259 - protein, 17 aa, synthetic construct
  source 1..17: note = Description of Artificial Sequence: Synthetic peptide
SINPYTREIQYNERFRG

SEQ ID NO: 8260 - protein, 17 aa, synthetic construct
  source 1..17: note = Description of Artificial Sequence: Synthetic peptide
FINPYTNDIQYNERFRG

SEQ ID NO: 8261 - protein, 17 aa, synthetic construct
  source 1..17: note = Description of Artificial Sequence: Synthetic peptide
AINPYTNEIKYNERFRG

SEQ ID NO: 8262 - protein, 9 aa, synthetic construct
  source 1..9: note = Description of Artificial Sequence: Synthetic peptide
SQSTHLPYT

SEQ ID NO: 8263 - protein, 17 aa, synthetic construct
  source 1..17: note = Description of Artificial Sequence: Synthetic peptide
AINPYNDDIQYNERFRG

SEQ ID NO: 8264 - protein, 17 aa, synthetic construct
  source 1..17: note = Description of Artificial Sequence: Synthetic peptide
YINPYNNDIKYNQKFQG

SEQ ID NO: 8265 - protein, 9 aa, synthetic construct
  source 1..9: note = Description of Artificial Sequence: Synthetic peptide
SQSTQEPYT

SEQ ID NO: 8266 - protein, 17 aa, synthetic construct
  source 1..17: note = Description of Artificial Sequence: Synthetic peptide
TINPYTREIQYNQKFQG

SEQ ID NO: 8267 - protein, 17 aa, synthetic construct
  source 1..17: note = Description of Artificial Sequence: Synthetic peptide
YINPYNNEIQYNQKFQG

SEQ ID NO: 8268 - protein, 17 aa, synthetic construct
  source 1..17: note = Description of Artificial Sequence: Synthetic peptide
AINPYNHEIQYNQKFQG

SEQ ID NO: 8269 - protein, 17 aa, synthetic construct
  source 1..17: note = Description of Artificial Sequence: Synthetic peptide
TINPYKHHIKYNERFRG

SEQ ID NO: 8270 - protein, 17 aa, synthetic construct
  source 1..17: note = Description of Artificial Sequence: Synthetic peptide
FINPYTRAIKYNERFRG

SEQ ID NO: 8271 - protein, 16 aa, synthetic construct
  source 1..16: note = Description of Artificial Sequence: Synthetic peptide
RSSKNLVHSNARTYLQ

SEQ ID NO: 8272 - protein, 10 aa, synthetic construct
  source 1..10: note = Description of Artificial Sequence: Synthetic peptide
PRGFYGYHMH

SEQ ID NO: 8273 - protein, 17 aa, synthetic construct
  source 1..17: note = Description of Artificial Sequence: Synthetic peptide
SINPYTRHIQYNERFRG

SEQ ID NO: 8274 - protein, 10 aa, synthetic construct
  source 1..10: note = Description of Artificial Sequence: Synthetic peptide
SQSSLLPYTF

SEQ ID NO: 8275 - skipped

SEQ ID NO: 8276 - protein, 16 aa, synthetic construct
  source 1..16: note = Description of Artificial Sequence: Synthetic peptide
RSSQNLVHSNARTYLQ

SEQ ID NO: 8277 - protein, 9 aa, synthetic construct
  source 1..9: note = Description of Artificial Sequence: Synthetic peptide
SQSTLEPFT

SEQ ID NO: 8278 - skipped

SEQ ID NO: 8279 - protein, 9 aa, synthetic construct
  source 1..9: note = Description of Artificial Sequence: Synthetic peptide
SQSSHIPYT

SEQ ID NO: 8280 - protein, 9 aa, synthetic construct
  source 1..9: note = Description of Artificial Sequence: Synthetic peptide
SQSSLVPYT

SEQ ID NO: 8281 - protein, 219 aa, synthetic construct; identical to SEQ ID NO: 8005
  source 1..219: note = Description of Artificial Sequence: Synthetic polypeptide

SEQ ID NO: 8282 - protein, 115 aa, synthetic construct
  source 1..115: note = Description of Artificial Sequence: Synthetic polypeptide
DVVMTQSPLSLPVTLGQPASISCCDRRSSKNLVHSNGRTYLQWYQQRPGQSPRLLIYRVSNRFPGVPDRFSGSGSGTDFTLKISRVEAEDVGVYFCSQSTREPYTFGGGTKVEIK

SEQ ID NO: 8283 - protein, 454 aa, synthetic construct
  source 1..454: note = Description of Artificial Sequence: Synthetic polypeptide
QVQLVQSGAEVKKPGSSVKVSCKASPRGFYGYHMHWVRQAPGQGLEWMGFINPYNNHIQYNERFRGRVTITSDESTTTAYMELSSLRSEDTAVYYCALGIGKWGDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8284 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYNNHIQYNERFRGRVTITSDESTTTAYMELSSLRSEDTAVYYCALGIGKWGDGAYRFFDFWGQGTLVTVSS

SEQ ID NO: 8285 - protein, 15 aa, synthetic construct
  source 1..15: note = Description of Artificial Sequence: Synthetic peptide
GIGKWGDGAYRFFDF

SEQ ID NO: 8286 - protein, 473 aa, synthetic construct; identical to SEQ ID NO: 7383
  source 1..473: note = Description of Artificial Sequence: Synthetic polypeptide

SEQ ID NO: 8287 - protein, 246 aa, synthetic construct; identical to SEQ ID NO: 7311
  source 1..246: note = Description of Artificial Sequence: Synthetic polypeptide

SEQ ID NO: 8288 - protein, 12 aa, synthetic construct
  source 1..12: note = Description of Artificial Sequence: Synthetic peptide
GFSITTTGYHWN

SEQ ID NO: 8289 - protein, 16 aa, synthetic construct
  source 1..16: note = Description of Artificial Sequence: Synthetic peptide
YIYSSGSTSYNPSLKS

SEQ ID NO: 8290 - protein, 8 aa, synthetic construct
  source 1..8: note = Description of Artificial Sequence: Synthetic peptide
GDWHYFDY

SEQ ID NO: 8291 - protein, 20 aa, synthetic construct
  source 1..20: note = Description of Artificial Sequence: Synthetic peptide
GGGGSGGGGSGGGGSGGGGS

SEQ ID NO: 8292 - protein, 219 aa, synthetic construct; identical to SEQ ID NO: 8005
  source 1..219: note = Description of Artificial Sequence: Synthetic polypeptide

SEQ ID NO: 8293 - protein, 112 aa, synthetic construct; identical to SEQ ID NO: 8014
  source 1..112: note = Description of Artificial Sequence: Synthetic polypeptide

SEQ ID NO: 8294 - protein, 454 aa, synthetic construct
  source 1..454: note = Description of Artificial Sequence: Synthetic polypeptide
QVQLVQSGAEVKKPGSSVKVSCKASPRGFYGYHMHWVRQAPGQGLEWMGFINPYNNHIQYNERFRGRVTITSDESTTTAYMELSSLRSEDTAVYYCALGVGKWGDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8295 - protein, 124 aa, synthetic construct
  source 1..124: note = Description of Artificial Sequence: Synthetic polypeptide
QVQLVQSGAEVKKPGSSVKVSCKASPRGFYGYHMHWVRQAPGQGLEWMGFINPYNNHIQYNERFRGRVTITSDESTTTAYMELSSLRSEDTAVYYCALGVGKWGDGAYRFFDFWGQGTLVTVSS

SEQ ID NO: 8296 - protein, 15 aa, synthetic construct
  source 1..15: note = Description of Artificial Sequence: Synthetic peptide
GVGKWGDGAYRFFDF

SEQ ID NO: 8297 - protein, 219 aa, synthetic construct; identical to SEQ ID NO: 8005
  source 1..219: note = Description of Artificial Sequence: Synthetic polypeptide

SEQ ID NO: 8298 - protein, 454 aa, synthetic construct; identical to SEQ ID NO: 8007
  source 1..454: note = Description of Artificial Sequence: Synthetic polypeptide

SEQ ID NO: 8299 - protein, 124 aa, synthetic construct; identical to SEQ ID NO: 8020
  source 1..124: note = Description of Artificial Sequence: Synthetic polypeptide

SEQ ID NO: 8300 - protein, 227 aa, synthetic construct
  source 1..227: note = Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 8301 - protein, 219 aa, synthetic construct; identical to SEQ ID NO: 8005
  source 1..219: note = Description of Artificial Sequence: Synthetic polypeptide

SEQ ID NO: 8302 - protein, 454 aa, synthetic construct; identical to SEQ ID NO: 8009
  source 1..454: note = Description of Artificial Sequence: Synthetic polypeptide

SEQ ID NO: 8303 - protein, 124 aa, synthetic construct; identical to SEQ ID NO: 8022
  source 1..124: note = Description of Artificial Sequence: Synthetic polypeptide

SEQ ID NO: 8304 - protein, 124 aa, synthetic construct; identical to SEQ ID NO: 7351
  source 1..124: note = Description of Artificial Sequence: Synthetic polypeptide

SEQ ID NO: 8305 - protein, 10 aa, synthetic construct
  source 1..10: note = Description of Artificial Sequence: Synthetic peptide
GYTFTGYVMH

SEQ ID NO: 8306 - protein, 227 aa, synthetic construct
  source 1..227: note = Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8307 - protein, 219 aa, synthetic construct; identical to SEQ ID NO: 7380
  source 1..219: note = Description of Artificial Sequence: Synthetic polypeptide

SEQ ID NO: 8308 - protein, 112 aa, synthetic construct; identical to SEQ ID NO: 258
  source 1..112: note = Description of Artificial Sequence: Synthetic polypeptide

SEQ ID NO: 8309 - protein, 454 aa, synthetic construct; identical to SEQ ID NO: 7382
  source 1..454: note = Description of Artificial Sequence: Synthetic polypeptide

SEQ ID NO: 8310 - protein, 124 aa, synthetic construct; identical to SEQ ID NO: 7351
  source 1..124: note = Description of Artificial Sequence: Synthetic polypeptide

SEQ ID NO: 8311-8399 - skipped (89 entries)

SEQ ID NO: 8400 - protein, 25 aa, synthetic construct
  source 1..25: note = Description of Artificial Sequence: Synthetic peptide
EVRLQQSGPDLIKPGASVKMSCKAS

SEQ ID NO: 8401 - protein, 10 aa, synthetic construct
  source 1..10: note = Description of Artificial Sequence: Synthetic peptide
GYTFTGYVMH

SEQ ID NO: 8402 - protein, 25 aa, synthetic construct [sequence omitted]

SEQ ID NO: 8403 - protein, 25 aa, synthetic construct [sequence omitted]

SEQ ID NO: 8404 - protein, 25 aa, synthetic construct [sequence omitted]

SEQ ID NO: 8405 - protein, 25 aa, synthetic construct [sequence omitted]

SEQ ID NO: 8406-8505 - skipped (100 entries)

SEQ ID NO: 8506 - protein, 25 aa, synthetic construct
  source 1..25: note = Description of Artificial Sequence: Synthetic peptide
EVRLQQSGPDLIKPGASVKMSCKAS

SEQ ID NO: 8507 - protein, 10 aa, synthetic construct
  source 1..10: note = Description of Artificial Sequence: Synthetic peptide
GYTFTGYVMH

SEQ ID NO: 8508 - protein, 25 aa, synthetic construct [sequence omitted]

SEQ ID NO: 8509 - protein, 25 aa, synthetic construct [sequence omitted]

SEQ ID NO: 8510 - protein, 25 aa, synthetic construct [sequence omitted]

SEQ ID NO: 8511 - protein, 25 aa, synthetic construct [sequence omitted]

SEQ ID NO: 8512 - protein, 25 aa, synthetic construct [sequence omitted]

SEQ ID NO: 8513 - protein, 10 aa, synthetic construct
  source 1..10: note = Description of Artificial Sequence: Synthetic peptide
GYTFSGYAIS

SEQ ID NO: 8514 - protein, 25 aa, synthetic construct [sequence omitted]

SEQ ID NO: 8515 - protein, 25 aa, synthetic construct [sequence omitted]

SEQ ID NO: 8516 - protein, 25 aa, synthetic construct [sequence omitted]

SEQ ID NO: 8517 - protein, 10 aa, synthetic construct
  source 1..10: note = Description of Artificial Sequence: Synthetic peptide
GYTFTGYVMH

SEQ ID NO: 8518 - protein, 25 aa, synthetic construct [sequence omitted]

SEQ ID NO: 8519 - protein, 10 aa, synthetic construct
  source 1..10: note = Description of Artificial Sequence: Synthetic peptide
GYTFTGYVMH

SEQ ID NO: 8520 - protein, 25 aa, synthetic construct [sequence omitted]

SEQ ID NO: 8521 - protein, 10 aa, synthetic construct
  source 1..10: note = Description of Artificial Sequence: Synthetic peptide
GYTFTGYVMH

SEQ ID NO: 8522 - protein, 25 aa, synthetic construct [sequence omitted]

SEQ ID NO: 8523 - protein, 10 aa, synthetic construct
  source 1..10: note = Description of Artificial Sequence: Synthetic peptide
GYTFTGYVMH

SEQ ID NO: 8524 - protein, 25 aa, synthetic construct [sequence omitted]

SEQ ID NO: 8525 - protein, 10 aa, synthetic construct
  source 1..10: note = Description of Artificial Sequence: Synthetic peptide
GYTFTGYVMH

SEQ ID NO: 8526 - protein, 25 aa, synthetic construct [sequence omitted]

SEQ ID NO: 8527 - protein, 10 aa, synthetic construct
  source 1..10: note = Description of Artificial Sequence: Synthetic peptide
GYTFTGYVMH

SEQ ID NO: 8528 - protein, 25 aa, synthetic construct [sequence omitted]

SEQ ID NO: 8529 - protein, 10 aa, synthetic construct
  source 1..10: note = Description of Artificial Sequence: Synthetic peptide
GYTFPGFVMH

SEQ ID NO: 8530 - protein, 25 aa, synthetic construct [sequence omitted]

SEQ ID NO: 8531 - protein, 10 aa, synthetic construct
  source 1..10: note = Description of Artificial Sequence: Synthetic peptide
GYPFHGYVMH

SEQ ID NO: 8532 - protein, 25 aa, synthetic construct [sequence omitted]

SEQ ID NO: 8533 - protein, 10 aa, synthetic construct
  source 1..10: note = Description of Artificial Sequence: Synthetic peptide
GYTYPGYVMH

SEQ ID NO: 8534 - protein, 25 aa, synthetic construct [sequence omitted]

SEQ ID NO: 8535 - protein, 10 aa, synthetic construct
  source 1..10: note = Description of Artificial Sequence: Synthetic peptide
NQNFHGYHMH

SEQ ID NO: 8536 - protein, 25 aa, synthetic construct [sequence omitted]

SEQ ID NO: 8537 - protein, 10 aa, synthetic construct
  source 1..10: note = Description of Artificial Sequence: Synthetic peptide
SQNFHGFYMH

SEQ ID NO: 8538 - protein, 25 aa, synthetic construct [sequence omitted]

SEQ ID NO: 8539 - protein, 10 aa, synthetic construct
  source 1..10: note = Description of Artificial Sequence: Synthetic peptide
YQDFHGYKMH

SEQ ID NO: 8540 - protein, 25 aa, synthetic construct [sequence omitted]

SEQ ID NO: 8541 - protein, 10 aa, synthetic construct
  source 1..10: note = Description of Artificial Sequence: Synthetic peptide
GYNFHGFYMH

SEQ ID NO: 8542 - protein, 25 aa, synthetic construct [sequence omitted]

SEQ ID NO: 8543 - protein, 10 aa, synthetic construct
  source 1..10: note = Description of Artificial Sequence: Synthetic peptide
TSGFHGYPMH

SEQ ID NO: 8544 - protein, 25 aa, synthetic construct [sequence omitted]

SEQ ID NO: 8545 - protein, 10 aa, synthetic construct
  source 1..10: note = Description of Artificial Sequence: Synthetic peptide
PRGFHGYHMH

SEQ ID NO: 8546 - protein, 30 aa, synthetic construct; identical to SEQ ID NO: 7426
  source 1..30: note = Description of Artificial Sequence: Synthetic polypeptide

SEQ ID NO: 8547 - protein, 5 aa, synthetic construct
  source 1..5: note = Description of Artificial Sequence: Synthetic peptide
GYAMH

SEQ ID NO: 8548 - protein, 25 aa, synthetic construct [sequence omitted]

SEQ ID NO: 8549 - protein, 10 aa, synthetic construct
  source 1..10: note = Description of Artificial Sequence: Synthetic peptide
SKDFHGFAMH

SEQ ID NO: 8550 - protein, 25 aa, synthetic construct [sequence omitted]

SEQ ID NO: 8551 - protein, 10 aa, synthetic construct
  source 1..10: note = Description of Artificial Sequence: Synthetic peptide
PKGFHGYHMH

SEQ ID NO: 8552 - skipped

SEQ ID NO: 8553 - protein, 25 aa, synthetic construct
  source 1..25: note = Description of Artificial Sequence: Synthetic peptide
QIQLQESGPGLVKPSQSLSLTCSVT

SEQ ID NO: 8554 - protein, 12 aa, synthetic construct
  source 1..12: note = Description of Artificial Sequence: Synthetic peptide
GFSINTGGYHWN

SEQ ID NO: 8555 - protein, 25 aa, synthetic construct
  source 1..25: note = Description of Artificial Sequence: Synthetic peptide
QIQLQESGPGLVKPSQSLSLTCSVT

SEQ ID NO: 8556 - protein, 12 aa, synthetic construct
  source 1..12: note = Description of Artificial Sequence: Synthetic peptide
GFSINTGGYHWN

SEQ ID NO: 8557 - protein, 25 aa, synthetic construct
  source 1..25: note = Description of Artificial Sequence: Synthetic peptide
QIQLQESGPGLVKPSETLSLTCTVS

SEQ ID NO: 8558 - protein, 12 aa, synthetic construct
  source 1..12: note = Description of Artificial Sequence: Synthetic peptide
GFSINTGGYHWN

SEQ ID NO: 8559 - protein, 25 aa, synthetic construct
  source 1..25: note = Description of Artificial Sequence: Synthetic peptide
QIQLQESGPGLVKPSQTLSLTCTVS

SEQ ID NO: 8560 - protein, 12 aa, synthetic construct
  source 1..12: note = Description of Artificial Sequence: Synthetic peptide
GFSINTGGYHWN

SEQ ID NO: 8561 - protein, 25 aa, synthetic construct
  source 1..25: note = Description of Artificial Sequence: Synthetic peptide
EIQLLESGGGLVQPGGSLRLSCAVS

SEQ ID NO: 8562 - protein, 12 aa, synthetic construct
  source 1..12: note = Description of Artificial Sequence: Synthetic peptide
GFSINTGGYHWN

SEQ ID NO: 8563 - protein, 25 aa, synthetic construct
  source 1..25: note = Description of Artificial Sequence: Synthetic peptide
QIQLVQSGAEVKKPGSSVKVSCKVS

SEQ ID NO: 8564 - protein, 12 aa, synthetic construct
  source 1..12: note = Description of Artificial Sequence: Synthetic peptide
GFSINTGGYHWN

SEQ ID NO: 8565 - protein, 25 aa, synthetic construct
  source 1..25: note = Description of Artificial Sequence: Synthetic peptide
EIQLVESGGGLVQPGGSLRLSCAVS

SEQ ID NO: 8566 - protein, 12 aa, synthetic construct
  source 1..12: note = Description of Artificial Sequence: Synthetic peptide
GFSINTGGYHWN

SEQ ID NO: 8567 - protein, 25 aa, synthetic construct
  source 1..25: note = Description of Artificial Sequence: Synthetic peptide
QIQLVQSGAEVKKPGASVKVSCKVS

SEQ ID NO: 8568 - protein, 12 aa, synthetic construct
  source 1..12: note = Description of Artificial Sequence: Synthetic peptide
GFSINTGGYHWN

SEQ ID NO: 8569 - protein, 25 aa, synthetic construct
  source 1..25: note = Description of Artificial Sequence: Synthetic peptide
QIQLQESGPGLVKPSQTLSLTCTVS

SEQ ID NO: 8570 - protein, 12 aa, synthetic construct
  source 1..12: note = Description of Artificial Sequence: Synthetic peptide
GFSINTGGYHWN

SEQ ID NO: 8571 - protein, 25 aa, synthetic construct
  source 1..25: note = Description of Artificial Sequence: Synthetic peptide
QIQLQESGPGLVKPSETLSLTCTVS

SEQ ID NO: 8572 - protein, 12 aa, synthetic construct
  source 1..12: note = Description of Artificial Sequence: Synthetic peptide
GFSINTGGYHWN

SEQ ID NO: 8573 - protein, 25 aa, synthetic construct
  source 1..25: note = Description of Artificial Sequence: Synthetic peptide
EIQLLESGGGLVQPGGSLRLSCAVS

SEQ ID NO: 8574 - protein, 12 aa, synthetic construct
  source 1..12: note = Description of Artificial Sequence: Synthetic peptide
GFSINTGGYHWN

SEQ ID NO: 8575 - protein, 25 aa, synthetic construct
  source 1..25: note = Description of Artificial Sequence: Synthetic peptide
QIQLVESGGGLVKPGGSLRLSCAVS

SEQ ID NO: 8576 - protein, 12 aa, synthetic construct
  source 1..12: note = Description of Artificial Sequence: Synthetic peptide
GFSINTGGYHWN

SEQ ID NO: 8577 - protein, 25 aa, synthetic construct
  source 1..25: note = Description of Artificial Sequence: Synthetic peptide
QIQLVQSGAEVKKPGASVKVSCKVS

SEQ ID NO: 8578 - protein, 12 aa, synthetic construct
  source 1..12: note = Description of Artificial Sequence: Synthetic peptide
GFSINTGGYHWN

SEQ ID NO: 8579 - protein, 25 aa, synthetic construct
  source 1..25: note = Description of Artificial Sequence: Synthetic peptide
EIQLVQSGAEVKKPGATVKISCKVS

SEQ ID NO: 8580 - protein, 12 aa, synthetic construct
  source 1..12: note = Description of Artificial Sequence: Synthetic peptide
GFSINTGGYHWN

SEQ ID NO: 8581 - protein, 25 aa, synthetic construct
  source 1..25: note = Description of Artificial Sequence: Synthetic peptide
QIQLQESGPGLVKPSQSLSLTCSVT

SEQ ID NO: 8582 - protein, 12 aa, synthetic construct
  source 1..12: note = Description of Artificial Sequence: Synthetic peptide
GFSINTGGYHWN

SEQ ID NO: 8583 - protein, 25 aa, synthetic construct
  source 1..25: note = Description of Artificial Sequence: Synthetic peptide
QIQLQESGPGLVKPSQSLSLTCSVT

SEQ ID NO: 8584 - protein, 12 aa, synthetic construct
  source 1..12: note = Description of Artificial Sequence: Synthetic peptide
GFSINTGGYHWN

SEQ ID NO: 8585 - protein, 25 aa, synthetic construct
  source 1..25: note = Description of Artificial Sequence: Synthetic peptide
QIQLQESGPGLVKPSETLSLTCTVS

SEQ ID NO: 8586 - protein, 12 aa, synthetic construct
  source 1..12: note = Description of Artificial Sequence: Synthetic peptide
GFSINTGGYHWN

SEQ ID NO: 8587 - protein, 25 aa, synthetic construct
  source 1..25: note = Description of Artificial Sequence: Synthetic peptide
QIQLQESGPGLVKPSQTLSLTCTVS

SEQ ID NO: 8588 - protein, 12 aa, synthetic construct
  source 1..12: note = Description of Artificial Sequence: Synthetic peptide
GFSINTGGYHWN

SEQ ID NO: 8589 - protein, 25 aa, synthetic construct
  source 1..25: note = Description of Artificial Sequence: Synthetic peptide
EIQLLESGGGLVQPGGSLRLSCAVS

SEQ ID NO: 8590 - protein, 12 aa, synthetic construct
  source 1..12: note = Description of Artificial Sequence: Synthetic peptide
GFSINTGGYHWN

SEQ ID NO: 8591 - protein, 25 aa, synthetic construct
  source 1..25: note = Description of Artificial Sequence: Synthetic peptide
QIQLVQSGAEVKKPGSSVKVSCKVS

SEQ ID NO: 8592 - protein, 12 aa, synthetic construct
  source 1..12: note = Description of Artificial Sequence: Synthetic peptide
GFSINTGGYHWN

SEQ ID NO: 8593 - protein, 25 aa, synthetic construct
  source 1..25: note = Description of Artificial Sequence: Synthetic peptide
EIQLVESGGGLVQPGGSLRLSCAVS

SEQ ID NO: 8594 - protein, 12 aa, synthetic construct
  source 1..12: note = Description of Artificial Sequence: Synthetic peptide
GFSINTGGYHWN

SEQ ID NO: 8595 - protein, 25 aa, synthetic construct
  source 1..25: note = Description of Artificial Sequence: Synthetic peptide
QIQLVQSGAEVKKPGASVKVSCKVS

SEQ ID NO: 8596 - protein, 12 aa, synthetic construct
  source 1..12: note = Description of Artificial Sequence: Synthetic peptide
GFSINTGGYHWN

SEQ ID NO: 8597 - protein, 25 aa, synthetic construct
  source 1..25: note = Description of Artificial Sequence: Synthetic peptide
QIQLQESGPGLVKPSQTLSLTCTVS

SEQ ID NO: 8598 - protein, 12 aa, synthetic construct
  source 1..12: note = Description of Artificial Sequence: Synthetic peptide
GFSINTGGYHWN

SEQ ID NO: 8599 - protein, 25 aa, synthetic construct
  source 1..25: note = Description of Artificial Sequence: Synthetic peptide
QIQLQESGPGLVKPSETLSLTCTVS

SEQ ID NO: 8600 - protein, 12 aa, synthetic construct
  source 1..12: note = Description of Artificial Sequence: Synthetic peptide
GFSINTGGYHWN

SEQ ID NO: 8601 - protein, 25 aa, synthetic construct
  source 1..25: note = Description of Artificial Sequence: Synthetic peptide
EIQLLESGGGLVQPGGSLRLSCAVS

SEQ ID NO: 8602 - protein, 12 aa, synthetic construct
  source 1..12: note = Description of Artificial Sequence: Synthetic peptide
GFSINTGGYHWN

SEQ ID NO: 8603 - protein, 25 aa, synthetic construct
  source 1..25: note = Description of Artificial Sequence: Synthetic peptide
QIQLVESGGGLVKPGGSLRLSCAVS

SEQ ID NO: 8604 - protein, 12 aa, synthetic construct
  source 1..12: note = Description of Artificial Sequence: Synthetic peptide
GFSINTGGYHWN

SEQ ID NO: 8605 - protein, 25 aa, synthetic construct
  source 1..25: note = Description of Artificial Sequence: Synthetic peptide
QIQLVQSGAEVKKPGASVKVSCKVS

SEQ ID NO: 8606 - protein, 12 aa, synthetic construct
  source 1..12: note = Description of Artificial Sequence: Synthetic peptide
GFSINTGGYHWN

SEQ ID NO: 8607 - protein, 25 aa, synthetic construct
  source 1..25: note = Description of Artificial Sequence: Synthetic peptide
EIQLVQSGAEVKKPGATVKISCKVS

SEQ ID NO: 8608 - protein, 12 aa, synthetic construct
  source 1..12: note = Description of Artificial Sequence: Synthetic peptide
GFSINTGGYHWN

SEQ ID NO: 8609 - protein, 25 aa, synthetic construct
  source 1..25: note = Description of Artificial Sequence: Synthetic peptide
QIQLQESGPGLVKPSQSLSLSCSVT

SEQ ID NO: 8610 - protein, 12 aa, synthetic construct
  source 1..12: note = Description of Artificial Sequence: Synthetic peptide
GFSINTGGYHWN

SEQ ID NO: 8611 - protein, 25 aa, synthetic construct
  source 1..25: note = Description of Artificial Sequence: Synthetic peptide
QIQLQESGPGLVKPSQSLSLTCSVT

SEQ ID NO: 8612 - protein, 12 aa, synthetic construct
  source 1..12: note = Description of Artificial Sequence: Synthetic peptide
GFSINTGGYHWN

SEQ ID NO: 8613 - protein, 25 aa, synthetic construct
  source 1..25: note = Description of Artificial Sequence: Synthetic peptide
QIQLQESGPGLVKPSQSLSLTCSVT

SEQ ID NO: 8614 - protein, 12 aa, synthetic construct
  source 1..12: note = Description of Artificial Sequence: Synthetic peptide
GFSINTGGYHWN

SEQ ID NO: 8615 - protein, 25 aa, synthetic construct
  source 1..25: note = Description of Artificial Sequence: Synthetic peptide
QIQLQESGPGLVKPSQSLSLSCSVT

SEQ ID NO: 8616 - protein, 12 aa, synthetic construct
  source 1..12: note = Description of Artificial Sequence: Synthetic peptide
GFSITTTGYHWN

SEQ ID NO: 8617 - protein, 25 aa, synthetic construct
  source 1..25: note = Description of Artificial Sequence: Synthetic peptide
QIQLQESGPGLVKPSQTLSLTCTVS

SEQ ID NO: 8618 - protein, 12 aa, synthetic construct
  source 1..12: note = Description of Artificial Sequence: Synthetic peptide
GFSITTTGYHWN

SEQ ID NO: 8619 - protein, 25 aa, synthetic construct
  source 1..25: note = Description of Artificial Sequence: Synthetic peptide
QIQLVESGGGLVKPGGSLRLSCAVS

SEQ ID NO: 8620 - protein, 12 aa, synthetic construct
  source 1..12: note = Description of Artificial Sequence: Synthetic peptide
GFSITTTGYHWN

SEQ ID NO: 8621 - protein, 25 aa, synthetic construct
  source 1..25: note = Description of Artificial Sequence: Synthetic peptide
EIQLLESGGGLVQPGGSLRLSCAVS

SEQ ID NO: 8622 - protein, 12 aa, synthetic construct
  source 1..12: note = Description of Artificial Sequence: Synthetic peptide
GFSITTTGYHWN

SEQ ID NO: 8623 - protein, 25 aa, synthetic construct
  source 1..25: note = Description of Artificial Sequence: Synthetic peptide
EIQLVESGGGLVQPGGSLRLSCAVS

SEQ ID NO: 8624 - protein, 12 aa, synthetic construct
  source 1..12: note = Description of Artificial Sequence: Synthetic peptide
GFSITTTGYHWN

SEQ ID NO: 8625 - protein, 25 aa, synthetic construct
  source 1..25: note = Description of Artificial Sequence: Synthetic peptide
QIQLVQSGAEVKKPGASVKVSCKVS

SEQ ID NO: 8626 - protein, 12 aa, synthetic construct
  source 1..12: note = Description of Artificial Sequence: Synthetic peptide
GFSITTTGYHWN

SEQ ID NO: 8627 - protein, 25 aa, synthetic construct
  source 1..25: note = Description of Artificial Sequence: Synthetic peptide
EIQLLESGGGLVQPGGSLRLSCAVS

SEQ ID NO: 8628 - protein, 12 aa, synthetic construct
  source 1..12: note = Description of Artificial Sequence: Synthetic peptide
GFSITTTGYHWN

SEQ ID NO: 8629 - protein, 25 aa, synthetic construct
  source 1..25: note = Description of Artificial Sequence: Synthetic peptide
EIQLLESGGGLVQPGGSLRLSCAVS

SEQ ID NO: 8630 - protein, 12 aa, synthetic construct
  source 1..12: note = Description of Artificial Sequence: Synthetic peptide
GFSITTTGYHWN

SEQ ID NO: 8631 - protein, 25 aa, synthetic construct
  source 1..25: note = Description of Artificial Sequence: Synthetic peptide
EIQLLESGGGLVQPGGSLRLSCAVS

SEQ ID NO: 8632 - protein, 12 aa, synthetic construct
  source 1..12: note = Description of Artificial Sequence: Synthetic peptide
GFSITTTGYHWN

SEQ ID NO: 8633 - protein, 25 aa, synthetic construct
  source 1..25: note = Description of Artificial Sequence: Synthetic peptide
EIQLLESGGGLVQPGGSLRLSCAVS

SEQ ID NO: 8634 - protein, 12 aa, synthetic construct
  source 1..12: note = Description of Artificial Sequence: Synthetic peptide
GFSITTTGYHWN

SEQ ID NO: 8635 - protein, 25 aa, synthetic construct
  source 1..25: note = Description of Artificial Sequence: Synthetic peptide
EIQLLESGGGLVQPGGSLRLSCAVS

SEQ ID NO: 8636 - protein, 12 aa, synthetic construct
  source 1..12: note = Description of Artificial Sequence: Synthetic peptide
GFSITTTGYHWN

SEQ ID NO: 8637 - protein, 25 aa, synthetic construct
  source 1..25: note = Description of Artificial Sequence: Synthetic peptide
EIQLLESGGGLVQPGGSLRLSCAVS

SEQ ID NO: 8638 - protein, 12 aa, synthetic construct
  source 1..12: note = Description of Artificial Sequence: Synthetic peptide
GFSITTTGYHWN

SEQ ID NO: 8639 - protein, 25 aa, synthetic construct
  source 1..25: note = Description of Artificial Sequence: Synthetic peptide
EIQLLESGGGLVQPGGSLRLSCAVS

SEQ ID NO: 8640 - protein, 12 aa, synthetic construct
  source 1..12: note = Description of Artificial Sequence: Synthetic peptide
GFSITTTGYHWN

SEQ ID NO: 8641 - protein, 25 aa, synthetic construct
  source 1..25: note = Description of Artificial Sequence: Synthetic peptide
EIQLLESGGGLVQPGGSLRLSCAVS

SEQ ID NO: 8642 - protein, 12 aa, synthetic construct
  source 1..12: note = Description of Artificial Sequence: Synthetic peptide
GFSITTTGYHWN

SEQ ID NO: 8643 - protein, 5 aa, synthetic construct
  source 1..5: note = Description of Artificial Sequence: Synthetic peptide
GYVMH

SEQ ID NO: 8644 - protein, 17 aa, synthetic construct
  source 1..17: note = Description of Artificial Sequence: Synthetic peptide
FINPYNDDIQSNERFRG

SEQ ID NO: 8645 - protein, 15 aa, synthetic construct
  source 1..15: note = Description of Artificial Sequence: Synthetic peptide
GAGYNFDGAYRFFDF

SEQ ID NO: 8646 - protein, 16 aa, synthetic construct
  source 1..16: note = Description of Artificial Sequence: Synthetic peptide
RSSQRLVHSNGNTYLH

SEQ ID NO: 8647 - protein, 7 aa, synthetic construct
  source 1..7: note = Description of Artificial Sequence: Synthetic peptide
RVSNRFP

SEQ ID NO: 8648 - protein, 9 aa, synthetic construct
  source 1..9: note = Description of Artificial Sequence: Synthetic peptide
SQSTHVPYT

SEQ ID NO: 8649 - protein, 17 aa, synthetic construct
  source 1..17: note = Description of Artificial Sequence: Synthetic peptide
FIIPIFGTANYAQKFQG

SEQ ID NO: 8650 - protein, 15 aa, synthetic construct
  source 1..15: note = Description of Artificial Sequence: Synthetic peptide
GAGYNFDGAYRFFDF

SEQ ID NO: 8651 - protein, 16 aa, synthetic construct
  source 1..16: note = Description of Artificial Sequence: Synthetic peptide
RSSQRLVHSNGNTYLH

SEQ ID NO: 8652 - protein, 7 aa, synthetic construct
  source 1..7: note = Description of Artificial Sequence: Synthetic peptide
RVSNRFP

SEQ ID NO: 8653 - protein, 9 aa, synthetic construct
  source 1..9: note = Description of Artificial Sequence: Synthetic peptide
SQSTHVPYT

SEQ ID NO: 8654 - protein, 17 aa, synthetic construct
  source 1..17: note = Description of Artificial Sequence: Synthetic peptide
FINPYNDDIQSNERFRG

SEQ ID NO: 8655 - protein, 15 aa, synthetic construct
  source 1..15: note = Description of Artificial Sequence: Synthetic peptide
GAGYNFDGAYRFFDF

SEQ ID NO: 8656 - protein, 16 aa, synthetic construct
  source 1..16: note = Description of Artificial Sequence: Synthetic peptide
RSSQRLVHSNGNTYLH

SEQ ID NO: 8657 - protein, 7 aa, synthetic construct
  source 1..7: note = Description of Artificial Sequence: Synthetic peptide
RVSNRFP

SEQ ID NO: 8658 - protein, 9 aa, synthetic construct
  source 1..9: note = Description of Artificial Sequence: Synthetic peptide
SQSTHVPYT

SEQ ID NO: 8659 - protein, 17 aa, synthetic construct
  source 1..17: note = Description of Artificial Sequence: Synthetic peptide
FIIPIFGTANYAQKFQG

SEQ ID NO: 8660 - protein, 15 aa, synthetic construct
  source 1..15: note = Description of Artificial Sequence: Synthetic peptide
GAGYNFDGAYRFFDF

SEQ ID NO: 8661 - protein, 16 aa, synthetic construct
  source 1..16: note = Description of Artificial Sequence: Synthetic peptide
RSSQRLVHSNGNTYLH

SEQ ID NO: 8662 - protein, 7 aa, synthetic construct
  source 1..7: note = Description of Artificial Sequence: Synthetic peptide
RVSNRFP

SEQ ID NO: 8663 - protein, 9 aa, synthetic construct
  source 1..9: note = Description of Artificial Sequence: Synthetic peptide
SQSTHVPYT

SEQ ID NO: 8664 - protein, 17 aa, synthetic construct
  source 1..17: note = Description of Artificial Sequence: Synthetic peptide
FINPYNDDIQSNERFRG

SEQ ID NO: 8665 - protein, 15 aa, synthetic construct
  source 1..15: note = Description of Artificial Sequence: Synthetic peptide
GAGYNFDGAYRFFDF

SEQ ID NO: 8666 - protein, 16 aa, synthetic construct
  source 1..16: note = Description of Artificial Sequence: Synthetic peptide
RSSQRLVHSNGNTYLH

SEQ ID NO: 8667 - protein, 7 aa, synthetic construct
  source 1..7: note = Description of Artificial Sequence: Synthetic peptide
RVSNRFP

SEQ ID NO: 8668 - protein, 9 aa, synthetic construct
  source 1..9: note = Description of Artificial Sequence: Synthetic peptide
SQSTHVPYT

SEQ ID NO: 8669 - protein, 454 aa, synthetic construct
  source 1..454: note = Description of Artificial Sequence: Synthetic polypeptide
QVQLVQSGAEVKKPGSSVKVSCKASPRGFYGYVMHWVRQAPGQGLEWMGFINPYTNDIQYNERFRGRVTITSDKSTTTAYMELSSLRSEDTAVYYCARGNGKWGDGAYRFFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8670 - protein, 112 aa, synthetic construct
  source 1..112: note = Description of Artificial Sequence: Synthetic polypeptide
DVVMTQSPLSLPVTLGQPASISCRSSKNLVHSNGRTYLQWYLQKPGQSPQLLIYRVSNRFPGVPDRFSGSGSGTDFTLKISRVEAEDVGVYFCSQSTHVPYTFGGGTKVEIK

SEQ ID NO: 8671 - protein, 17 aa, synthetic construct
  source 1..17: note = Description of Artificial Sequence: Synthetic peptide
YINPYNHDIQYNQKFQG

SEQ ID NO: 8672 - protein, 10 aa, synthetic construct
  source 1..10: note = Description of Artificial Sequence: Synthetic peptide
PRGFYGYAMH

SEQ ID NO: 8673 - protein, 16 aa, synthetic construct
  source 1..16: note = Description of Artificial Sequence: Synthetic peptide
RSSQRLVHSNANTYLH

SEQ ID NO: 8674 - protein, 10 aa, synthetic construct
  source 1..10: note = Description of Artificial Sequence: Synthetic peptide
SQSTHVPYTF

SEQ ID NO: 8675 - protein, 9 aa, synthetic construct
  source 1..9: note = Description of Artificial Sequence: Synthetic peptide
GGGTKVEIK

SEQ ID NO: 8676 - protein, 16 aa, synthetic construct
  source 1..16: note = Description of Artificial Sequence: Synthetic peptide
RSSQRLVHSNGNAYLH

SEQ ID NO: 8677 - protein, 16 aa, synthetic construct
  source 1..16: note = Description of Artificial Sequence: Synthetic peptide
RSSQRLVHSNANAYLH

SEQ ID NO: 8678 - protein, 16 aa, synthetic construct
  source 1..16: note = Description of Artificial Sequence: Synthetic peptide
RSSQRLVHSGGNTYLH

SEQ ID NO: 8679 - protein, 16 aa, synthetic construct
  source 1..16: note = Description of Artificial Sequence: Synthetic peptide
RSSQRLVHSNGSTYLH

SEQ ID NO: 8680 - protein, 16 aa, synthetic construct
  source 1..16: note = Description of Artificial Sequence: Synthetic peptide
RSSQRLVHSGGSTYLH

SEQ ID NO: 8681 - protein, 112 aa, synthetic construct
  source 1..112: note = Description of Artificial Sequence: Synthetic polypeptide
DVVMTQSPLSLPVTLGQPASISCRSSQRLVHSNANTYLHWYQQRPGQSPRLLIYRVSNRFPGVPDRFSGSGSGTDFTLKISRVEAEDVGVYFCSQSTHVPYTFGGGTKVEIK

SEQ ID NO: 8682 - protein, 112 aa, synthetic construct
  source 1..112: note = Description of Artificial Sequence: Synthetic polypeptide
DVVMTQSPLSLPVTLGQPASISCRSSQRLVHSNGNAYLHWYQQRPGQSPRLLIYRVSNRFPGVPDRFSGSGSGTDFTLKISRVEAEDVGVYFCSQSTHVPYTFGGGTKVEIK

SEQ ID NO: 8683 - protein, 112 aa, synthetic construct
  source 1..112: note = Description of Artificial Sequence: Synthetic polypeptide
DVVMTQSPLSLPVTLGQPASISCRSSQRLVHSNANAYLHWYQQRPGQSPRLLIYRVSNRFPGVPDRFSGSGSGTDFTLKISRVEAEDVGVYFCSQSTHVPYTFGGGTKVEIK

SEQ ID NO: 8684 - protein, 112 aa, synthetic construct
  source 1..112: note = Description of Artificial Sequence: Synthetic polypeptide
DVVMTQSPLSLPVTLGQPASISCRSSQRLVHSGGNTYLHWYQQRPGQSPRLLIYRVSNRFPGVPDRFSGSGSGTDFTLKISRVEAEDVGVYFCSQSTHVPYTFGGGTKVEIK

SEQ ID NO: 8685 - protein, 112 aa, synthetic construct
  source 1..112: note = Description of Artificial Sequence: Synthetic polypeptide
DVVMTQSPLSLPVTLGQPASISCRSSQRLVHSNGSTYLHWYQQRPGQSPRLLIYRVSNRFPGVPDRFSGSGSGTDFTLKISRVEAEDVGVYFCSQSTHVPYTFGGGTKVEIK

SEQ ID NO: 8686 - protein, 112 aa, synthetic construct
  source 1..112: note = Description of Artificial Sequence: Synthetic polypeptide
DVVMTQSPLSLPVTLGQPASISCRSSQRLVHSGGSTYLHWYQQRPGQSPRLLIYRVSNRFPGVPDRFSGSGSGTDFTLKISRVEAEDVGVYFCSQSTHVPYTFGGGTKVEIK

SEQ ID NO: 8687 - protein, 28 aa, synthetic construct
  source 1..28: note = Description of Artificial Sequence: Synthetic peptide
EIQLLESGGGLVQPGGSLRLSCAVSGFS

SEQ ID NO: 8688 - protein, 16 aa, synthetic construct
  source 1..16: note = Description of Artificial Sequence: Synthetic peptide
YIYSSGSTSYAPSLKS

SEQ ID NO: 8689 - protein, 10 aa, synthetic construct
  source 1..10: note = Description of Artificial Sequence: Synthetic peptide
QFWDSTASAV

SEQ ID NO: 8690 - protein, 10 aa, synthetic construct
  source 1..10: note = Description of Artificial Sequence: Synthetic peptide
QFWASTNSAV

SEQ ID NO: 8691 - protein, 10 aa, synthetic construct
  source 1..10: note = Description of Artificial Sequence: Synthetic peptide
QFWASTASAV

SEQ ID NO: 8692 - protein, 118 aa, synthetic construct
  source 1..118: note = Description of Artificial Sequence: Synthetic polypeptide
EIQLLESGGGLVQPGGSLRLSCAVSGFSITTTGYHWNWVRQAPGKGLEWVGYIYSSGSTSYAPSLKSRFTISRDTSKNTFYLQMNSLRAEDTAVYYCARGDWHYFDYWGQGTMVTVSS

SEQ ID NO: 8693 - protein, 108 aa, synthetic construct
  source 1..108: note = Description of Artificial Sequence: Synthetic polypeptide
DSVTTQSPLSLPVTLGQPASISCSGEKLSDKYVHWYQQRPGQSPRMLIYENDRRPSGVPDRFSGSNSGNDATLKISRVEAEDVGVYFCQFWDSTASAVFGGGTKVEIK

SEQ ID NO: 8694 - protein, 108 aa, synthetic construct
  source 1..108: note = Description of Artificial Sequence: Synthetic polypeptide
DSVTTQSPLSLPVTLGQPASISCSGEKLSDKYVHWYQQRPGQSPRMLIYENDRRPSGVPDRFSGSNSGNDATLKISRVEAEDVGVYFCQFWASTNSAVFGGGTKVEIK

SEQ ID NO: 8695 - protein, 107 aa, synthetic construct
  source 1..107: note = Description of Artificial Sequence: Synthetic polypeptide
SSETTQPPSVSVSPGQTASITCSGEKLSDKYVHWYQQKPGQSPVMVIYENDRRPSGIPERFSGSNSGNTATLTISGTQAMDEADYFCQFWASTNSAVFGGGTQLTVL

SEQ ID NO: 8696 - protein, 107 aa, synthetic construct
  source 1..107: note = Description of Artificial Sequence: Synthetic polypeptide
SSETTQPPSVSVSPGQTASITCSGEKLSDKYVHWYQQKPGQSPVMVIYENDRRPSGIPERFSGSNSGNTATLTISGTQAMDEADYFCQFWDSTASAVFGGGTQLTVL

SEQ ID NO: 8697 - protein, 108 aa, synthetic construct
  source 1..108: note = Description of Artificial Sequence: Synthetic polypeptide
DSVTTQSPLSLPVTLGQPASISCSGEKLSDKYVHWYQQRPGQSPRMLIYENDRRPSGVPDRFSGSNSGNDATLKISRVEAEDVGVYFCQFWASTASAVFGGGTKVEIK

SEQ ID NO: 8698 - protein, 107 aa, synthetic construct
  source 1..107: note = Description of Artificial Sequence: Synthetic polypeptide
SSETTQPPSVSVSPGQTASITCSGEKLSDKYVHWYQQKPGQSPVMVIYENDRRPSGIPERFSGSNSGNTATLTISGTQAMDEADYFCQFWASTASAVFGGGTQLTVL

SEQ ID NO: 8699 - protein, 246 aa, synthetic construct
  source 1..246: note = Description of Artificial Sequence: Synthetic polypeptide
EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSSGGGGSGGGGSGGGGSGGGGSDSVTTQSPLSLPVTLGQPASISCSGEKLSDKYVHWYQQRPGQSPRMLIYENDRRPSGVPDRFSGSNSGNDATLKISRVEAEDVGVYFCQFWDSTASAVFGGGTKVEIK

SEQ ID NO: 8700 - protein, 246 aa, synthetic construct
  source 1..246: note = Description of Artificial Sequence: Synthetic polypeptide
EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSSGGGGSGGGGSGGGGSGGGGSDSVTTQSPLSLPVTLGQPASISCSGEKLSDKYVHWYQQRPGQSPRMLIYENDRRPSGVPDRFSGSNSGNDATLKISRVEAEDVGVYFCQFWASTNSAVFGGGTKVEIK

SEQ ID NO: 8701 - protein, 245 aa, synthetic construct
  source 1..245: note = Description of Artificial Sequence: Synthetic polypeptide
EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSSGGGGSGGGGSGGGGSGGGGSSSETTQPPSVSVSPGQTASITCSGEKLSDKYVHWYQQKPGQSPVMVIYENDRRPSGIPERFSGSNSGNTATLTISGTQAMDEADYFCQFWASTNSAVFGGGTQLTVL

SEQ ID NO: 8702 - protein, 245 aa, synthetic construct
  source 1..245: note = Description of Artificial Sequence: Synthetic polypeptide
EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSSGGGGSGGGGSGGGGSGGGGSSSETTQPPSVSVSPGQTASITCSGEKLSDKYVHWYQQKPGQSPVMVIYENDRRPSGIPERFSGSNSGNTATLTISGTQAMDEADYFCQFWDSTASAVFGGGTQLTVL

SEQ ID NO: 8703 - protein, 246 aa, synthetic construct
  source 1..246: note = Description of Artificial Sequence: Synthetic polypeptide
EIQLLESGGGLVQPGGSLRLSCAVSGFSITTTGYHWNWVRQAPGKGLEWVGYIYSSGSTSYAPSLKSRFTISRDTSKNTFYLQMNSLRAEDTAVYYCARGDWHYFDYWGQGTMVTVSSGGGGSGGGGSGGGGSGGGGSDSVTTQSPLSLPVTLGQPASISCSGEKLSDKYVHWYQQRPGQSPRMLIYENDRRPSGVPDRFSGSNSGNDATLKISRVEAEDVGVYFCQFWDSTNSAVFGGGTKVEIK

SEQ ID NO: 8704 - protein, 245 aa, synthetic construct
  source 1..245: note = Description of Artificial Sequence: Synthetic polypeptide
EIQLLESGGGLVQPGGSLRLSCAVSGFSITTTGYHWNWVRQAPGKGLEWVGYIYSSGSTSYAPSLKSRFTISRDTSKNTFYLQMNSLRAEDTAVYYCARGDWHYFDYWGQGTMVTVSSGGGGSGGGGSGGGGSGGGGSSSETTQPPSVSVSPGQTASITCSGEKLSDKYVHWYQQKPGQSPVMVIYENDRRPSGIPERFSGSNSGNTATLTISGTQAMDEADYFCQFWDSTNSAVFGGGTQLTVL

SEQ ID NO: 8705 - protein, 246 aa, synthetic construct
  source 1..246: note = Description of Artificial Sequence: Synthetic polypeptide
EIQLLESGGGLVQPGGSLRLSCAVSGFSITTTGYHWNWVRQAPGKGLEWVGYIYSSGSTSYAPSLKSRFTISRDTSKNTFYLQMNSLRAEDTAVYYCARGDWHYFDYWGQGTMVTVSSGGGGSGGGGSGGGGSGGGGSDSVTTQSPLSLPVTLGQPASISCSGEKLSDKYVHWYQQRPGQSPRMLIYENDRRPSGVPDRFSGSNSGNDATLKISRVEAEDVGVYFCQFWASTASAVFGGGTKVEIK

SEQ ID NO: 8706 - protein, 245 aa, synthetic construct
  source 1..245: note = Description of Artificial Sequence: Synthetic polypeptide
EIQLLESGGGLVQPGGSLRLSCAVSGFSITTTGYHWNWVRQAPGKGLEWVGYIYSSGSTSYAPSLKSRFTISRDTSKNTFYLQMNSLRAEDTAVYYCARGDWHYFDYWGQGTMVTVSSGGGGSGGGGSGGGGSGGGGSSSETTQPPSVSVSPGQTASITCSGEKLSDKYVHWYQQKPGQSPVMVIYENDRRPSGIPERFSGSNSGNTATLTISGTQAMDEADYFCQFWASTASAVFGGGTQLTVL

We claim:

1. A multifunctional molecule comprising:

(a) a first antigen binding domain that binds to a T cell receptor beta chain constant domain 2 (TRBC2), wherein:

the first antigen binding domain comprises a VH comprising a VHCDR1, a VHCDR2, and a VHCDR3 that comprise the sequences of SEQ ID NO: 8041, SEQ ID NO: 8044, and SEQ ID NO: 8046, respectively; and a VL comprising a VLCDR1, a VLCDR2, and a VLCDR3 of SEQ ID NO: 8051, SEQ ID NO: 8049, and SEQ ID NO: 8052, respectively; and (b) a second antigen binding domain that binds to NKp30, wherein:

the second antigen binding domain comprises a VH comprising a VHCDR1, a VHCDR2, and a VHCDR3 that comprise the sequences of SEQ ID NO: 7313, SEQ ID NO: 6001, and SEQ ID NO: 7315, respectively; and a VL comprising a VLCDR1, a VLCDR2, and a VLCDR3 of SEQ ID NO: 7326, SEQ ID NO: 7327, and SEQ ID NO: 7329, respectively.

2. The multifunctional molecule of claim 1, wherein the first antigen binding domain comprises:

a VH comprising a sequence having at least 85% identity to SEQ ID NO: 8020;

a VL comprising a sequence having at least 85% identity to SEQ ID NO: 8021.

3. The multifunctional molecule of claim 1, wherein the first antigen binding domain comprises:

a VH and a VL comprising the sequences of SEQ ID NO: 8020, and SEQ ID NO: 8021, respectively.

4. The multifunctional molecule of claim 1, wherein the second antigen binding domain that binds to NKp30 comprises:

(i) a VH comprising a sequence having at least 85% identity to SEQ ID NO: 7302; and (ii) a VL comprising a sequence having at least 85% identity to SEQ ID NO: 7309.

5. The multifunctional molecule of claim 1, wherein the second antigen binding domain that binds to NKp30 comprises a VH and a VL comprising the sequences of:

SEQ ID NO: 7302 and SEQ ID NO: 7309, respectively.

6. The multifunctional molecule of claim 1, wherein the multifunctional molecule comprises a dimerization module comprising one or more immunoglobulin chain constant regions.

7. The multifunctional molecule of claim 6, wherein the one or more immunoglobulin chain constant regions are Fc regions comprising one or more of: a paired cavity-protuberance, an electrostatic interaction, or a strand-exchange.

8. The multifunctional molecule of claim 1, wherein the multifunctional molecule comprises a heavy chain constant region variant comprising one or more mutations that result in reduced or ablated affinity for at least one Fc receptor.

9. The multifunctional molecule of claim 1, wherein the multifunctional molecule further comprises one, two, or all of a cytokine molecule, a cytokine inhibitor molecule, a death receptor signal engager, and a stromal modifying moiety.

10. The multifunctional molecule of claim 9, wherein:

(i) the cytokine molecule is selected from the group consisting of interleukin-2 (IL-2) or functional variant thereof, interleukin-7 (IL-7) or functional variant thereof, interleukin-12 (IL-12) or functional variant thereof, interleukin-15 (IL-15) or functional variant thereof, interleukin-18 (IL-18) or functional variant thereof, interleukin-21 (IL-21) or functional variant thereof, interferon gamma or functional variant thereof, and any combination thereof, (ii) the cytokine inhibitor molecule is a TGF-beta inhibitor;

(iii) the death receptor signal engager is selected from the group consisting of a TNF-related apoptosis-inducing ligand (TRAIL) molecule, a death receptor molecule, and an antigen binding domain that specifically binds to a death receptor; or (iv) any combination thereof.

11. The multifunctional molecule of claim 1, wherein the multifunctional molecule comprises the following configuration:

A-, B-[dimerization module]-C, -D, wherein:

(A) the dimerization module comprises immunoglobulin constant domains;

(B) A, B, C, and D are independently (i) absent; (ii) the first antigen binding domain; (iii) the second antigen binding domain that binds to NKp30; (iv) a cytokine molecule or a cytokine inhibitor molecule; (v) a death receptor signal engager; or (vi) a stromal modifying moiety.

12. The multifunctional molecule of claim 1, wherein the multifunctional molecule comprises a first polypeptide chain, a second polypeptide chain, and a third polypeptide chain, and wherein:

(i) the first polypeptide chain comprises a sequence having at least 85% identity to the sequence of SEQ ID NO: 8007;

(ii) the second polypeptide chain comprises a sequence having at least 85% identity to the sequence of SEQ ID NO: 8008; and (iii) the third polypeptide chain comprises a sequence having at least 85% identity to the sequence of SEQ ID NO: 7384.

13. The multifunctional molecule of claim 1, wherein the multifunctional molecule comprises a first polypeptide chain, a second polypeptide chain, and a third polypeptide chain, and wherein:

(i) the first polypeptide chain comprises the sequence of SEQ ID NO: 8007, (ii) the second polypeptide chain comprises the sequence of SEQ ID NO: 8008; and (iii) the third polypeptide chain comprises the sequence of SEQ ID NO: 7384.

14. A polynucleotide comprising a sequence encoding the multifunctional molecule of claim 1.

15. A method of making the multifunctional molecule of claim 1 comprising: culturing a cell comprising a polynucleotide that comprises a sequence encoding the multifunctional molecule under conditions suitable for gene expression and/or homo- or heterodimerization.

16. A pharmaceutical composition comprising the multifunctional molecule of claim 1, and a pharmaceutically acceptable carrier, excipient, or stabilizer for use in therapy.

17. A method of treating cancer in a subject in need thereof comprising: administering an effective amount of the multifunctional molecule of claim 1 to the subject, thereby treating the cancer in the subject; and wherein the cancer is TRBC2+.

18. The method of claim 17, wherein:

(i) the cancer is a T cell cancer, or the cancer is leukemia or lymphoma;

(ii) the cancer is selected from the group consisting of Acquired immune deficiency syndrome (AIDS)-associated lymphoma, Angioimmunoblastic T-cell lymphoma, Adult T-cell leukemia/lymphoma, Burkitt lymphoma, Central nervous system (CNS) lymphoma, Diffuse large B-cell lymphoma (DLBCL), Lymphoblastic lymphoma, Mantle cell lymphoma (MCL), Peripheral T-cell lymphoma (PTCL), Transformed follicular and transformed mucosa-associated lymphoid tissue (MALT) lymphomas, Cutaneous T-cell lymphoma, Follicular lymphoma, Lymphoplasmacytic lymphoma/Waldenström macroglobulinemia, Marginal zone B-cell lymphoma, Gastric mucosa-associated lymphoid tissue (MALT) lymphoma, Chronic lymphocytic leukemia/small-cell lymphocytic lymphoma (CLL/SLL), Extranodal T-/NK-cell lymphoma, and Anaplastic large-cell lymphoma; or (iii) the cancer is Peripheral T-cell lymphoma (PTCL).

19. The method of claim 18, wherein:

(i) the peripheral T-cell lymphoma (PTCL) is Hepatosplenic T-cell lymphoma (HSGDTCL), Subcutaneous paniculitis-like T-cell lymphoma, or Enteropathy-associated T-cell lymphoma;

(ii) the cutaneous T-cell lymphoma is mycosis fungoides and Sézary syndrome;

(iii) the extranodal T-cell lymphoma is a nasal type;

(iv) the anaplastic large-cell lymphoma is primary cutaneous anaplastic large-cell lymphoma or systemic anaplastic large-cell lymphoma; or (v) any combination thereof.

* * * * *